US010077453B2

(12) United States Patent
Liu et al.

(10) Patent No.: US 10,077,453 B2
(45) Date of Patent: Sep. 18, 2018

(54) CAS9 PROTEINS INCLUDING LIGAND-DEPENDENT INTEINS

(71) Applicant: President and Fellows of Harvard College, Cambridge, MA (US)

(72) Inventors: David R. Liu, Lexington, MA (US); Kevin Davis, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 42 days.

(21) Appl. No.: 15/329,925

(22) PCT Filed: Jul. 30, 2015

(86) PCT No.: PCT/US2015/042770
§ 371 (c)(1),
(2) Date: Jan. 27, 2017

(87) PCT Pub. No.: WO2016/022363
PCT Pub. Date: Feb. 11, 2016

(65) Prior Publication Data
US 2017/0268022 A1    Sep. 21, 2017

Related U.S. Application Data

(60) Provisional application No. 62/135,629, filed on Mar. 19, 2015, provisional application No. 62/030,943, filed on Jul. 30, 2014.

(51) Int. Cl.
| C12N 15/90 | (2006.01) |
| C07K 14/35 | (2006.01) |
| C07K 14/72 | (2006.01) |
| C12N 9/22  | (2006.01) |
| C12N 9/78  | (2006.01) |
| C12N 9/02  | (2006.01) |
| C12N 15/63 | (2006.01) |

(52) U.S. Cl.
CPC ............ *C12N 15/907* (2013.01); *C07K 14/35* (2013.01); *C07K 14/721* (2013.01); *C12N 9/0071* (2013.01); *C12N 9/22* (2013.01); *C12N 9/78* (2013.01); *C12N 15/63* (2013.01); *C12Y 114/11* (2013.01); *C12Y 305/04* (2013.01); *C07K 2319/92* (2013.01)

(58) Field of Classification Search
CPC ........ C12N 9/22; A61K 39/46; A61K 39/465; C12Y 301/00
See application file for complete search history.

(56) References Cited

U.S. PATENT DOCUMENTS

| 4,235,871 A | 11/1980 | Papahadjopoulos et al. |
| 4,501,728 A | 2/1985  | Geho et al. |
| 4,737,323 A | 4/1988  | Martin et al. |
| 4,837,028 A | 6/1989  | Allen |
| 5,580,737 A | 12/1996 | Polisky et al. |
| 5,767,099 A | 6/1998  | Harris et al. |
| 5,780,053 A | 7/1998  | Ashley et al. |
| 5,830,430 A | 11/1998 | Unger et al. |
| 5,851,548 A | 12/1998 | Dattagupta et al. |
| 5,855,910 A | 1/1999  | Ashley et al. |
| 6,057,153 A | 5/2000  | George et al. |
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,607,882 B1 | 8/2003 | Cox, III et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,163,824 B2 | 1/2007 | Cox, III et al. |
| 7,479,573 B2 | 1/2009 | Chu et al. |
| 7,794,931 B2 | 9/2010 | Breaker et al. |
| 7,919,277 B2 | 4/2011 | Russell et al. |
| 7,993,672 B2 | 8/2011 | Huang et al. |
| 8,361,725 B2 | 1/2013 | Russell et al. |
| 8,492,082 B2 | 7/2013 | De Franciscis et al. |
| 8,546,553 B2 | 10/2013 | Terns et al. |
| 8,569,256 B2 | 10/2013 | Heyes et al. |

(Continued)

FOREIGN PATENT DOCUMENTS

| AU | 2012244264 A1 | 11/2012 |
| AU | 2015252023 A1 | 11/2015 |

(Continued)

OTHER PUBLICATIONS

U.S. Appl. No. 14/911,117, filed Feb. 9, 2016, Liu et al.
U.S. Appl. No. 14/326,318, filed Jul. 8, 2014, Liu et al.
U.S. Appl. No. 61/716,256, Jinek et al., filed Oct. 19, 2012.
U.S. Appl. No. 61/717,324, Cho et al., filed Oct. 23, 2012.
U.S. Appl. No. 61/734,256, Chen et al., filed Dec. 6, 2012.
U.S. Appl. No. 61/758,624, Chen et al., filed Jan. 30, 2013.
U.S. Appl. No. 61/761,046, Knight et al., filed Feb. 5, 2013.

(Continued)

*Primary Examiner* — Karen Cochrane Carlson
(74) *Attorney, Agent, or Firm* — Wolf, Greenfield & Sacks, P.C.

(57) ABSTRACT

Some aspects of this disclosure provide compositions, methods, systems, and kits for controlling the activity of RNA-programmable endonucleases, such as Cas9, or for controlling the activity of proteins comprising a Cas9 variant fused to a functional effector domain, such as a nuclease, nickase, recombinase, deaminase, transcriptional activator, transcriptional repressor, or epigenetic modifying domain. For example, the inventive proteins provided comprise a ligand-dependent intein, the presence of which inhibits one or more activities of the protein (e.g., gRNA binding, enzymatic activity, target DNA binding). The binding of a ligand to the intein results in self-excision of the intein, restoring the activity of the protein.

21 Claims, 12 Drawing Sheets
Specification includes a Sequence Listing.

(56) References Cited

U.S. PATENT DOCUMENTS

| | | |
|---|---|---|
| 8,680,069 B2 | 3/2014 | de Fougerolles et al. |
| 8,691,750 B2 | 4/2014 | Constien et al. |
| 8,697,359 B1 | 4/2014 | Zhang |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,846,578 B2 | 9/2014 | McCray et al. |
| 8,993,233 B2 | 3/2015 | Zhang et al. |
| 8,999,641 B2 | 4/2015 | Zhang et al. |
| 9,068,179 B1 | 6/2015 | Liu et al. |
| 9,163,284 B2 | 10/2015 | Liu et al. |
| 9,228,207 B2 | 1/2016 | Liu et al. |
| 9,234,213 B2 | 1/2016 | Wu |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,512,446 B1 | 12/2016 | Joung et al. |
| 9,526,724 B2 | 12/2016 | Liu et al. |
| 2004/0003420 A1 | 1/2004 | Kuhn et al. |
| 2004/0115184 A1 | 6/2004 | Smith et al. |
| 2005/0222030 A1 | 10/2005 | Allison et al. |
| 2006/0088864 A1 | 4/2006 | Smolke et al. |
| 2007/0264692 A1 | 11/2007 | Liu et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0316643 A1 | 12/2010 | Eckert et al. |
| 2011/0059160 A1 | 3/2011 | Essner et al. |
| 2011/0104787 A1 | 5/2011 | Church et al. |
| 2011/0189776 A1 | 8/2011 | Terns et al. |
| 2011/0217739 A1 | 9/2011 | Terns et al. |
| 2012/0129759 A1 | 5/2012 | Liu et al. |
| 2012/0141523 A1 | 6/2012 | Castado et al. |
| 2012/0270273 A1 | 10/2012 | Zhang et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0344117 A1 | 12/2013 | Mirosevich et al. |
| 2014/0004280 A1 | 1/2014 | Loomis et al. |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0186843 A1 | 7/2014 | Zhang et al. |
| 2014/0186958 A1 | 7/2014 | Zhang et al. |
| 2014/0234289 A1 | 8/2014 | Liu |
| 2014/0248702 A1 | 9/2014 | Cong |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens et al. |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0315252 A1 | 11/2015 | Haugwitz et al. |
| 2016/0017393 A1 | 1/2016 | Jacobson et al. |
| 2016/0017396 A1 | 1/2016 | Cann et al. |
| 2016/0032353 A1 | 2/2016 | Braman et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0138046 A1 | 5/2016 | Wu et al. |
| 2016/0015682 A2 | 6/2016 | Liu et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |

(56) References Cited

U.S. PATENT DOCUMENTS

| | | |
|---|---|---|
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0087224 A1 | 3/2017 | Quake et al. |
| 2017/0087225 A1 | 3/2017 | Quake et al. |
| 2017/0088587 A1 | 3/2017 | Quake et al. |
| 2017/0088828 A1 | 3/2017 | Quake et al. |
| 2017/0107560 A1 | 4/2017 | Peter et al. |

FOREIGN PATENT DOCUMENTS

| | | |
|---|---|---|
| AU | 2015101792 | 1/2016 |
| CA | 2 852 593 A1 | 11/2015 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |

(56) References Cited

FOREIGN PATENT DOCUMENTS

| | | |
|---|---|---|
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 3/2017 |
| CN | 106566838 A | 4/2017 |
| EP | 2 604 255 A1 | 6/2013 |
| EP | 2 966 170 A1 | 1/2016 |
| EP | 3 009 511 A2 | 4/2016 |
| GB | 2 528 177 A | 1/2016 |
| GB | 2 531 454 A1 | 4/2016 |
| JP | 2010-539929 A | 12/2010 |
| KR | 101584933 B1 | 1/2016 |
| KR | 20160133380 A | 11/2016 |
| WO | WO 2001/38547 A2 | 5/2001 |
| WO | WO 2002/068676 A2 | 9/2002 |
| WO | WO 2002/103028 A2 | 12/2002 |
| WO | WO 2006/002547 A1 | 1/2006 |
| WO | WO 2006/042112 A2 | 4/2006 |
| WO | WO 2007/025097 A2 | 3/2007 |
| WO | WO 2007/136815 A2 | 11/2007 |
| WO | WO 2007/143574 A1 | 12/2007 |
| WO | WO 2008/108989 A2 | 9/2008 |
| WO | WO 2009/134808 A2 | 11/2009 |
| WO | WO 2010/011961 A2 | 1/2010 |
| WO | WO 2010/054108 A2 | 5/2010 |
| WO | WO 2010/054154 A2 | 5/2010 |
| WO | WO 2010/068289 A2 | 6/2010 |
| WO | WO 2013/160230 A1 | 6/2010 |
| WO | WO 2010/075424 A2 | 7/2010 |
| WO | WO 2013/166315 A1 | 7/2010 |
| WO | WO 2010/102257 A2 | 9/2010 |
| WO | WO 2013/169398 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2013/169802 A1 | 11/2010 |
| WO | WO 2013/176772 A2 | 11/2010 |
| WO | WO 2013/176915 A1 | 11/2010 |
| WO | WO 2010/144150 A2 | 12/2010 |
| WO | WO 2013/176916 A1 | 12/2010 |
| WO | WO 2011/017293 A2 | 2/2011 |
| WO | WO 2013/181440 A1 | 2/2011 |
| WO | WO 2011/053868 A1 | 5/2011 |
| WO | WO 2011/053982 A2 | 5/2011 |
| WO | WO 2011/075627 A1 | 6/2011 |
| WO | WO 2011/091311 A2 | 7/2011 |
| WO | WO 2011/109031 A1 | 9/2011 |
| WO | WO 2011/143124 A2 | 11/2011 |
| WO | WO 2012/054726 A1 | 4/2012 |
| WO | WO 2012/065043 A2 | 5/2012 |
| WO | WO 2012/125445 A2 | 9/2012 |
| WO | WO 2012/138927 A2 | 10/2012 |
| WO | WO 2012/158985 A2 | 11/2012 |
| WO | WO 2012/158986 A2 | 11/2012 |
| WO | WO 2012/164565 A1 | 12/2012 |
| WO | WO 2013/012674 A1 | 1/2013 |
| WO | WO 2013/013105 A2 | 1/2013 |
| WO | WO 2013/066438 A2 | 5/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142378 A9 | 9/2013 |
| WO | WO 2013/142578 A2 | 9/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/059173 A2 | 4/2014 |

(56) References Cited

FOREIGN PATENT DOCUMENTS

| | | |
|---|---|---|
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/153118 A1 | 9/2014 |
| WO | WO 2014/153470 A2 | 9/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |

(56) References Cited

FOREIGN PATENT DOCUMENTS

| | | |
|---|---|---|
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A2 | 6/2015 |
| WO | WO 2015/086798 A1 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |

(56) References Cited

FOREIGN PATENT DOCUMENTS

| | | |
|---|---|---|
| WO | WO 2015/200555 A2 | 12/2015 |
| WO | WO 2015/200805 A2 | 12/2015 |
| WO | WO 2016/004010 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/014409 A1 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A1 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2015/048801 A2 | 4/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A2 | 4/2016 |
| WO | WO 2016/057951 A2 | 4/2016 |
| WO | WO 2016/057961 A2 | 4/2016 |
| WO | WO 2016/061073 A1 | 4/2016 |
| WO | WO 2016/061374 A1 | 4/2016 |
| WO | WO 2016/061523 A1 | 4/2016 |
| WO | WO 2016/069591 A2 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/112351 A1 | 7/2016 |
| WO | WO 2016/112963 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/130600 A2 | 8/2016 |
| WO | WO 2016/130697 A1 | 8/2016 |
| WO | WO 2016/132122 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/170484 A1 | 10/2016 |

(56) References Cited

FOREIGN PATENT DOCUMENTS

| | | |
|---|---|---|
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A2 | 12/2016 |
| WO | WO 2016/205764 A2 | 12/2016 |
| WO | WO 2017/001572 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/011519 A1 | 1/2017 |
| WO | WO 2017/011721 A1 | 1/2017 |
| WO | WO 2017/015015 A1 | 1/2017 |
| WO | WO 2017/015101 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/066175 A1 | 4/2017 |
| WO | WO 2017/066497 A2 | 4/2017 |
| WO | WO 2017/066588 A2 | 4/2017 |

OTHER PUBLICATIONS

U.S. Appl. No. 61/794,422, Knight et al., filed Feb. 15, 2013.
U.S. Appl. No. 61/803,599, Kim et al., filed Mar. 20, 2013.
U.S. Appl. No. 61/837,481, Cho et al., filed Jun. 20, 2013.
Partial Supplementary European Search Report for Application No. EP 12845790.0, dated Mar. 18, 2015.
Supplementary European Search Report for Application No. EP 12845790.0, dated Oct. 12, 2015.
International Search Report and Written Opinion for PCT/US2012/047778, dated May 30, 2013.
International Preliminary Report on Patentability for PCT/US2012/047778, dated Feb. 6, 2014.
International Search Report and Written Opinion for PCT/US2014/052231, dated Dec. 4, 2014
International Search Report and Written Opinion for PCT/US2014/052231, dated Jan. 30, 2015 (Corrected Version).
International Preliminary Report on Patentability for PCT/US2014/052231, dated Mar. 3, 2016.
International Search Report and Written Opinion for PCT/US2014/050283, dated Nov. 6, 2014.
International Preliminary Report on patentability for PCT/US2014/050283, dated Feb. 18, 2016.
International Search Report and Written Opinion for PCT/US2014/054247, dated Mar. 27, 2015.

(56) References Cited

OTHER PUBLICATIONS

International Preliminary Report on Patentability for PCT/US2014/054247, dated Mar. 17, 2016.
Invitation to Pay Additional Fees for PCT/US2014/054291, dated Dec. 18, 2014.
International Search Report and Written Opinion for PCT/US2014/054291, dated Mar. 27, 2015.
International Preliminary Report on Patentability for PCT/US2014/054291, dated Mar. 17, 2016.
International Search Report and Written Opinion for PCT/US2014/054252, dated Mar. 5, 2015.
International Preliminary Report on Patentability or PCT/US2014/054252, dated Mar. 17, 2016.
International Search Report and Written Opinion for PCT/US2014/070038, dated Apr. 14, 2015.
International Preliminary Report on Patentability for PCT/US2014/070038, dated Jun. 23, 2016.
International Search Report and Written Opinion for PCT/US2015/042770, dated Feb. 23, 2016.
International Preliminary Report on Patentability for PCT/US2015/042770, dated Dec. 19, 2016.
International Search Report and Written Opinion for PCT/US2015/058479, dated Feb. 11, 2016.
Invitation to Pay Additional Fees for PCT/US2016/058344, dated Mar. 1, 2017.
International Search Report and Written Opinion for PCT/US2016/058344, dated Apr. 20, 2017.
International Search Report for PCT/US2013/032589, dated Jul. 26, 2013.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Addgene Plasmid # 44246. pdCas9-humanized, 2017, Stanley Qi.
GENBANK Submission; NIH/NCBI, Accession No. J04623. Kita et al., Apr. 26, 1993. 2 pages.
GENBANK Submission; NIH/NCBI, Accession No. NC_002737.1. Ferretti et al., Jun. 27, 2013. 1 page.
GENBANK Submission; NIH/NCBI, Accession No. NC_015683.1. Trost et al., Jul. 6, 2013. 1 page.
GENBANK Submission; NIH/NCBI, Accession No. NC_016782.1. Trost et al., Jun. 11, 2013. 1 page.
GENBANK Submission; NIH/NCBI, Accession No. NC_016786.1. Trost et al., Aug. 28, 2013. 1 page.
GENBANK Submission; NIH/NCBI, Accession No. NC_017053.1. Fittipaldi et al., Jul. 6, 2013. 1 page.
GENBANK Submission; NIH/NCBI, Accession No. NC_017317.1. Trost et al., Jun. 11, 2013. 1 page.
GENBANK Submission; NIH/NCBI, Accession No. NC_017861.1. Heidelberg et al., Jun. 11, 2013. 1 page.
GENBANK Submission; NIH/NCBI, Accession No. NC_018010.1. Lucas et al., Jun. 11, 2013. 2 pages.
GENBANK Submission; NIH/NCBI, Accession No. NC_018721.1. Feng et al., Jun. 11, 2013. 1 pages.
GENBANK Submission; NIH/NCBI, Accession No. NC_021284.1. Ku et al., Jul. 12, 2013. 1 page.
GENBANK Submission; NIH/NCBI, Accession No. NC_021314.1. Zhang et al., Jul. 15, 2013. 1 page.
GENBANK Submission; NIH/NCBI, Accession No. NC_021846.1. Lo et al., Jul. 22, 2013. 1 page.
GENBANK Submission; NIH/NCBI, Accession No. NP_472073.1. Glaser et al., Jun. 27, 2013. 2 pages.
GENBANK Submission; NIH/NCBI, Accession No. P42212. Prasher et al., Mar. 19, 2014. 7 pages.
GENBANK Submission; NIH/NCBI, Accession No. YP_002342100.1. Bernardini et al., Jun. 10, 2013. 2 pages.
GENBANK Submission; NIH/NCBI, Accession No. YP_002344900.1. Gundogdu et al., Mar. 19, 2014. 2 pages.
GENBANK Submission; NIH/NCBI, Accession No. YP_820832.1. Makarova et al., Aug. 27, 2013. 2 pages.
NCBI Reference Sequence: NM_002427.3. Wu et al., May 3, 2014. 5 pages.
UNIPROT Submission; UniProt, Accession No. P01011. Last modified Jun. 11, 2014, version 2. 15 pages.
UNIPORT Submission; UniProt, Accession No. P01011. Last modified Sep. 18, 2013, version 2. 15 pages.
UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
[No. Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Beale et al., Comparison of the differential context-dependence of DNA deamination by APOBEC enzymes: correlation with mutation spectra in vivo. J Mol Biol. Mar. 26, 2004;337(3):585-96.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Beumer et al., Efficient gene targeting in Drosophila with zinc-finger nucleases. Genetics. Apr. 2006;172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Birling et al., Site-specific recombinases for manipulation of the mouse genome. Methods Mol Biol. 2009;561:245-63. doi: 10.1007/978-1-60327-019-9_16.
Boch, TALEs of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Borman, Improved route to single-base genome editing. Chemical & Engineering News, Apr. 25, 2016;94(17)p5. http://cen.acs.org/articles/94/i17/Improved-route-single-base-genome.html.
Branden and Tooze, Introduction to Protein Structure. 1999; 2nd edition. Garland Science Publisher: 3-12.
Britt et al., Re-engineering plant gene targeting. Trends Plant Sci. Feb. 2003;8(2):90-5.
Brown et al., Serine recombinases as tools for genome engineering. Methods. Apr. 2011;53(4):372-9. doi: 10.1016/j.ymeth.2010.12.031. Epub Dec. 30, 2010.
Brusse et al., Spinocerebellar ataxia associated with a mutation in the fibroblast growth factor 14 gene (SCA27): A new phenotype. Mov Disord. Mar. 2006;21(3):396-401.

(56) References Cited

OTHER PUBLICATIONS

Buchholz et al., Alteration of Cre recombinase site specificity by substrate-linked protein evolution. Nat Biotechnol. Nov. 2001;19(11):1047-52.
Bulow et al., Multienzyme systems obtained by gene fusion. Trends Biotechnol. Jul. 1991;9(7):226-31.
Cade et al., Highly efficient generation of heritable zebrafish gene mutations using homo—and heterodimeric TALENs. Nucleic Acids Res. Sep. 2012;40(16):8001-10. Doi: 10.1093/nar/gks518. Epub Jun. 7, 2012.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Cargill et al.,Characterization of single-nucleotide polymorphisms in coding regions of human genes. Nat Genet. Jul. 1999;22(3):231-8.
Caron et al., Intracellular delivery of a Tat-eGFP fusion protein into muscle cells. Mol Ther. Mar. 2001;3(3):310-8.
Carroll et al., Gene targeting in Drosophila and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A Crispr approach to gene targeting. Mol Ther. Sep. 2012;20(9):1658-60. doi: 10.1038/mt.2012.171.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Charpentier et al., Biotechnology: Rewriting a genome. Nature. Mar. 7, 2013;495(7439):50-1. doi: 10.1038/495050a.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. doi: https://doi.org/10.1101/058974. [Preprint].
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chichili et al., Linkers in the structural biology of protein-protein interactions. Protein Science. 2013;22:153-67.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRRISPR/Cas-derived RNA-guided endonucleases and nickases. Genome Res. Jan. 2014;24(1):132-41. doi: 10.1101/gr.162339.113. Epub Nov. 19, 2013.
Cho et al., Targeted genome engineering in human cells with the Cas9 RNA-guided endonuclease. Nat Biotechnol. Mat. 2013;31(3):230-2. doi: 10.1038/nbt.2507. Epub Jan. 29, 2013.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chu et al., Increasing the efficiency of homology-directed repair for CRISPR-Cas9-induced precise gene editing in mammalian cells. Nat Biotech. Feb. 13, 2015;33:543-8.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cole-Strauss et al., Correction of the mutation responsible for sickle cell anemia by an RNA-DNA oligonucleotide. Science. Sep. 6, 1996;273(5280):1386-9.
Cong et al., Multiplex genome engineering using CRISPR/Cas systems. Science. Feb. 15, 2013;339(6121):819-23. doi: 10.1126/science.1231143. Epub Jan. 3, 2013.
Conticello, The AID/APOBEC family of nucleic acid mutators. Genome Biol. 2008;9(6):229. doi: 10.1186/gb-2008-9-6-229. Epub Jun. 17, 2008.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Therapeutic genome editing: prospects and challenges. Nat Med. Feb. 2015;21(2):121-31. doi: 10.1038/nm.3793.
Cradick et al., CRISPR/Cas9 systems targeting ß-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2013;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Davis et al., Small molecule-triggered Cas9 protein with improved genome-editing specificity. Nat Chem Biol. 2015 May;11(5):316-8. doi: 10.1038/nchembio.1793. Epub Apr. 6, 2015.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Ding et al., A TALEN genome-editing system for generating human stem cell-based disease models. Cell Stem Cell. Feb. 7, 2013;12(2):238-51. Doi: 10.1016/j.stem.2012.11.011. Dec. 13, 2012.
Dormiani et al., Long-term and efficient expression of human ß-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

(56) References Cited

OTHER PUBLICATIONS

Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., an iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to Fold nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Hale et al., RNA-guided RNA cleavage by a CRISPR RNA-Cas protein complex. Cell. Nov. 25, 2009;139(5):945-56. doi: 10.1016/j.cell.2009.07.040.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hill et al., Functional analysis of conserved histidines in ADP-glucose pyrophosphorylase from *Escherichia coli*.Biochem Biophys Res Commun. Mar. 17, 1998;244(2):573-7.
Hilton et al., Enabling functional genomics with genome engineering. Genome Res. Oct. 2015;25(10):1442-55. doi: 10.1101/gr.190124.115.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Horvath et al., CRISPR/Cas, the immune system of bacteria and archaea. Science. Jan. 8, 2010;327(5962):167-70. doi: 10.1126/science.1179555.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit Rev Biochem Mol Biol. May-Jun, 2012;47(3):264-81. doi: 10.3109/10409238.2012.658112.

(56) References Cited

OTHER PUBLICATIONS

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Ikediobi et al., Mutation analysis of 24 known cancer genes in the NCI-60 cell line set. Mol Cancer Ther. Nov. 2006;5(11):2606-12. Epub Nov. 6, 2006.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.

Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.

Kaiser et al., Gene therapy. Putting the fingers on gene repair. Science. Dec. 23, 2005;310(5756):1894-6.

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

Kappel et al., Regulating gene expression in transgenic animals. Curr Opin Biotechnol. Oct. 1992;3(5):548-53.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Kellendonk et al., Regulation of Cre recombinase activity by the synthetic steroid RU 486. Nucleic Acids Res. Apr. 15, 1996;24(8):1404-11.

Kim et al., A library of TAL effector nucleases spanning the human genome. Nat Biotechnol. Mar. 2013;31(3):251-8. Doi: 10.1038/nbt.2517. Epub Feb. 17, 2013.

Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.

Kim et al., TALENs and ZFNs are associated with different mutationsignatures. Nat Methods. Mar. 2013;10(3):185. doi: 10.1038/nmeth.2364. Epub Feb. 10, 2013.

Kim et al., Targeted genome editing in human cells with zinc finger nucleases constructed via modular assembly. Genome Res. Jul. 2009;19(7):1279-88. doi: 10.1101/gr.089417.108. Epub May 21, 2009.

Kim et al., The role of apolipoprotein E in Alzheimer's disease. Neuron. Aug. 13, 2009;63(3):287-303. doi: 10.1016/j.neuron.2009.06.026.

Kim et al., Transcriptional repression by zinc finger peptides. Exploring the potential for applications in gene therapy. J Biol Chem. Nov. 21, 1997;272(47):29795-800.

Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.

Klippel et al., Isolation and characterization of unusual gin mutants. EMBO J. Dec. 1, 1988;7(12):3983-9.

Klippel et al., The DNA invertase Gin of phage Mu: formation of a covalent complex with DNA via a phosphoserine at amino acid position 9. EMBO J. Apr. 1988;7(4):1229-37.

Komor et al., Programmable editing of a target base in genomic DNA without double-stranded DNA cleavage. Nature. Apr. 20, 2016;533(7603):420-4. doi: 10.1038/nature17946.

Kumar et al., Structural and functional consequences of the mutation of a conserved arginine residue in alphaA and alphaB crystallins. J Biol Chem. Aug. 20, 19999;274(34):24137-41.

Kundu et al., Leucine to proline substitution by SNP at position 197 in Caspase-9 gene expression leads to neuroblastoma: a bioinformatics analysis. 3 Biotech. 2013; 3:225-34.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lavergne et al., Defects in type IIIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lazar et al., Transforming growth factor alpha: mutation of aspartic acid 47 and leucine 48 results in different biological activities. Mol Cell Biol. Mar. 1988;8(3):1247-52.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., PIK3CA gene is frequently mutated in breast carcinomas and hepatocellular carcinomas. Oncogene. Feb. 17, 2005;24(8):1477-80.

(56) References Cited

OTHER PUBLICATIONS

Lee et al., Recognition of liposomes by cells: in vitro binding and endocytosis mediated by specific lipid headgroups and surface charge density. Biochim Biophys Acta. Jan. 31, 1992;1103(2):185-97.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Codon 129 polymorphism of the human prion protein influences the kinetics of amyloid formation. J Gen Virol. Aug. 2006;87(Pt 8):2443-9.
Li et al., Current approaches for engineering proteins with diverse biological properties. Adv Exp Med Biol. 2007;620:18-33.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Lin et al., Enhanced homology-directed human genome engineering by controlled timing of CRISPR/Cas9 delivery. Elife. Dec. 15, 2014;3:e04766. doi: 10.7554/eLife.04766.
Liu et al., Apolipoprotein E and Alzheimer disease: risk, mechanisms and therapy. Nat Rev Neurol. Feb. 2013;9(2):106-18. doi: 10.1038/nrneurol.2012.263, Epub Jan. 8, 2013.
Liu et al., Cell-penetrating peptide-mediated delivery of TALEN proteins via bioconjugation for genome engineering. PLoS One. Jan. 20. 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Liu et al., Fast Colorimetric Sensing of Adenosine and Cocaine Based on a General Sensor Design Involving Aptamers and Nanoparticles. Angew Chem. 2006;118(1):96-100.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Ma et al., Targeted AID-mediated mutagenesis (TAM) enables efficient genomic diversification in mammalian cells. Nature Methods. Oct. 2016;13:1029-35. doi:10.1038/nmeth.4027.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Mali et al., Cas9 as a versatile tool for engineeringbiology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Mani et al., Design, engineering, and characterization of zinc finger nucleases. Biochem Biophys Res Commun. Sep. 23, 2005;335(2):447-57.
Marioni et al., DNA methylation age of blood predicts all-cause mortality in later life. Genome Biol. Jan. 30, 2015;16:25. doi: 10.1186/s13059-015-0584-6.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.
Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Miller et al., A TALE Nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Jul. 1, 2007.
Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.
Minoretti et al., a W148R mutation in the human FOXD4 gene segregating with dilated cardiomyopathy, obsessive-compulsive disorder, and suicidality. Int J Mol Med. Mar. 2007;19(3):369-72.
Mol et al., Crystal structure of human uracil-DNA glycosylase in complex with a protein inhibitor: protein mimicry of DNA. Cell. Sep. 8, 1995;82(5):701-8.
Moore et al., Improved somatic mutagenesis in zebrafish using transcription activator-like effector nucleases (TALENs). PLoS One. 2012;7(5):e37877. Doi: 10.1371/journal.pone.0037877. Epub May 24, 2012.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mullins et al., Transgenesis in nonmurine species. Hypertension. Oct. 1993;22(4):630-3.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Narayanan et al., Clamping down on weak terminal base pairs: oligonucleotides with molecular caps as fidelity-enhancing elements at the 5'—and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.

(56) References Cited

OTHER PUBLICATIONS

Nishida et al., Targeted nucleotide editing using hybrid prokaryotic and vertebrate adaptive immune systems. Science. Sep. 16, 2016;353(6305). pii: aaf8729. doi: 10.1126/science.aaf8729. Epub Aug. 4, 2016.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Noris et al., a phenylalanine-55 to serine amino-acid substitution in the human glycoprotein IX leucine-rich repeat is associated with Bernard-Soulier syndrome. Br J Haematol. May 1997;97(2):312-20.

O'Connell et al., Programmable RNA recognition and cleavage by CRISPRr/Cas9. Nature. Dec. 1, 2014;516(7530):263-6. doi: 10.1038/nature13769. Epub Sep. 28, 2014.

Offord, Advances in Genome Editing. The Scientist, Apr. 20, 2016. http://www.the-scientist.com/?articles.view/articleNo/45903/title/Advances-in-Genome-Editing/.

Osborn et al., TALEN-based gene correction for epidermolysis bullosa. Mol Ther. Jun. 2013;21(6):1151-9. doi: 10.1038/mt.2013.56. Epub Apr. 2, 2013.

Pan et al., Biological and biomedical applications of engineered nucleases. Mol Biotechnol. Sep. 2013;55(1):54-62. doi: 10.1007/s12033-012-9613-9.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pennisi et al., The CRISPR craze. Science. Aug. 23, 2013;341(6148):833-6. doi: 10.1126/science.341.6148.833.

Pennisi et al., the tale of the TALEs. Science. Dec. 14, 2012;338(6113):1408-11. doi: 10.1126/science.338.6113.1408.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Petek et al., Frequent endonuclease cleavage at off-target locations in vivo. Mol Ther. May 2010;18(5):983-6. Doi: 10.1038/mt.2010.35. Epub Mar. 9, 2010.

Petolino et al., Editing Plant Genomes: a new era of crop improvement. Plant Biotechnol J. Feb. 2016;14(2):435-6. doi: 10.1111/pbi.12542.

Phillips, The challenge of gene therapy and DNA delivery. J Pharm Pharmacol. Sep. 2001;53(9):1169-74.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.

Poller et al., A leucine-to-proline substitution causes a defective alpha 1-antichymotrypsin allele associated with familial obstructive lung disease. Genomics. Sep. 1993;17(3):740-3.

Porteus, Design and testing of zinc finger nucleases for use in mammalian cells. Methods Mol Biol. 2008;435:47-61. doi: 10.1007/978-1-59745-232-8_4.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double nicking by RNA-guided CRISPRr Cas9 for enhanced genome editing specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., in vivo genome editing using *Staphylococcus aureus* Cas9. Nature. Apr. 9, 2015;520(7546):186-91. doi: 10.1038/nature14299. Epub Apr. 1, 2015.

Rath et al., Fidelity of end joining in mammalian episomes and the impact of Metnase on joint processing. BMC Mol Biol. Mar. 22, 2014;15:6. doi: 10.1186/1471-2199-15-6.

Rebuzzini et al., New mammalian cellular systems to study mutations introduced at the break site by non-homologous end-joining. DNA Repair (Amst). May 2, 2005;4(5):546-55.

Reynaud et al., What role for AID: mutator, or assembler of the immunoglobulin mutasome? Nat Immunol. Jul. 2003;4(7):631-8.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Rong et al., Homologous recombination in human embryonic stem cells using CRISPR/Cas9 nickase and a long DNA donor template. Protein Cell. Apr. 2014;5(4):258-60. doi: 10.1007/s13238014-0032-5.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Sadelain et al., Safe harbours for the integration of new DNA in the human genome. Nat Rev Cancer. DEc. 1, 2011;12(1):51-8. doi: 10.1038/nrc3179.

(56) References Cited

OTHER PUBLICATIONS

Sage et al., Proliferation of functional hair cells in vivo in the absence of the retinoblastoma protein. Science. Feb. 18, 2005;307(5712):1114-8. Epub Jan. 13, 2005.
Samal et al., Cationic polymers and their therapeutic potential. Chem Soc Rev. Nov. 7, 2012;41(21):7147-94. doi: 10.1039/c2cs35094g. Epub Aug. 10, 2012.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang, Prospects for transgenesis in the chick. Mech Dev. Sep. 2004;121(9):1179-86.
Sanjana et al., a transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Schriefer et al., Low pressure DNA shearing: a method for random DNA sequence analysis. Nucleic Acids Res. Dec. 25, 1990;18(24):7455-6.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Seripa et al., The missing ApoE allele. Ann Hum Genet. Jul. 2007;71(Pt 4):496-500. Epub Jan. 22, 2007.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. May 19, 2011.
Siebert et al., An improved PCR method for walking in uncloned genomic DNA. Nucleic Acids Res. Mar. 25, 1995;23(6):1087-8.
Simonelli et al., Base excision repair intermediates are mutagenic in mammalian cells. Nucleic Acids Res. Aug. 2, 2005;33(14):4404-11. Print 2005.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Sjoblom et al., The consensus coding sequences of human breast and colorectal cancers. Science. Jan. 1, 2016;314(5797):268-74. Epub Sep. 7, 2006.
Slaymaker et al., Rationally engineered Cas9 nucleases with improved specificity. Science. Jan. 1, 2016;351(6268):84-8. doi: 10.1126/science.aad5227. Epub Dec. 1, 2015.
Smith et al., Expression of a dominant negative retinoic acid receptor = in Xenopus embryos leads to partial resistance to retinoic acid. Roux Arch Dev Biol. Mar. 1994;203(5):254-265. doi: 10.1007/BF00360521.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tagalakis et al., Lack of RNA-DNA oligonucleotide (chimeraplast) mutagenic activity in mouse embryos. Mol Reprod Dev. Jun. 2005;71(2):140-4.
Tebas et al., Gene editing of CCR5 in autologous CD4 T cells of persons infected with HIV. N Engl J Med. Mar. 6. 2014;370(10):901-10. doi: 10.1056/NEJMoa1300662.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thorpe et al., Functional correction of episomal mutations with short DNA fragments and RNA-DNA oligonucleotides. J Gene Med. Mar.-Apr., 2002;4(2):195-204.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.

(56) References Cited

OTHER PUBLICATIONS

Tirumalai et al., Recognition of core-type DNA sites by lambda integrase. J Mol Biol. Jan. 12, 1998;279(3):513-27.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of Tat-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPRr-Cas9 system. Science. Jan. 3, 2014;343(6166):80-4. doi: 10.1126/science.1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Weber et al., Assembly of designer TAL effectors by Golden Gate cloning. PLoS One. 2011;6(5):e19722. doi:10.1371/journal.pone.0019722. Epub May 19, 2011.
Weinberger et al., Disease-causing mutations C277R and C277Y modify gating of human C1C-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yang et al., Genome editing with targeted deaminases. BioRxiv. Preprint. First posted online Jul. 28, 2016.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuen et al., Control of transcription factor activity and osteoblast differentiation in mammalian cells using an evolved small-molecule-dependent intein. J Am Chem Soc. Jul. 12, 2006;128(27):8939-46.
Zetsche et al., a split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.

(56) References Cited

OTHER PUBLICATIONS

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zuris et al., Cationic lipid-mediated delivery of proteins enables efficient protein-based genome editing in vitro and in vivo. Nat Biotechnol. 2015;33:73-80.

CAS9 PROTEINS INCLUDING LIGAND-DEPENDENT INTEINS

RELATED APPLICATIONS

This application is a national stage filing under 35 U.S.C. § 371 of international PCT application, PCT/US2015/042770, filed Jul. 30, 2015, which claims priority under 35 U.S.C. § 119(e) to U.S. provisional patent application, U.S. Ser. No. 62/030,943, filed Jul. 30, 2014, and to U.S. provisional patent application, U.S. Ser. No. 62/135,629, filed Mar. 19, 2015, the entire contents of each of which are incorporated herein by reference.

GOVERNMENT SUPPORT

This invention was made with U.S. Government support under R01 GM095501 and F32GM106601, awarded by the National Institutes of Health/National Institute of General Medical Sciences, and under grant numbers HR0011-11-2-0003 and N66001-12-C-4207, awarded by the Department of Defense. The Government has certain rights in the invention.

BACKGROUND OF THE INVENTION

Site-specific enzymes theoretically allow for the targeted manipulation of a single site within a genome and are useful in the context of gene targeting as well as for therapeutic applications. In a variety of organisms, including mammals, site-specific enzymes such as endonucleases have been used for genome engineering by stimulating either non-homologous end joining or homologous recombination. In addition to providing powerful research tools, site-specific nucleases also have potential as gene therapy agents, and two site-specific endonucleases have recently entered clinical trials: one, CCR5-2246, targeting a human CCR-5 allele as part of an anti-HIV therapeutic approach (clinical trials NCT00842634, NCT01044654, NCT01252641), and the other one, VF24684, targeting the human VEGF-A promoter as part of an anti-cancer therapeutic approach (clinical trial NCT01082926).

Specific manipulation of the intended target site without or with only minimal off-target activity is a prerequisite for clinical applications of site-specific enzymes, and also for high-efficiency genomic manipulations in basic research applications. For example, imperfect specificity of engineered site-specific binding domains of certain nucleases has been linked to cellular toxicity and undesired alterations of genomic loci other than the intended target. Most nucleases available today, however, exhibit significant off-target activity, and thus may not be suitable for clinical applications. An emerging nuclease platform for use in clinical and research settings are the RNA-guided nucleases, such as Cas9. While these nucleases are able to bind guide RNAs (gRNAs) that direct cleavage of specific target sites, off-target activity is still observed for certain Cas9:gRNA complexes (Pattanayak et al., "High-throughput profiling of off-target DNA cleavage reveals RNA-programmed Cas9 nuclease specificity." *Nat Biotechnol.* 2013; doi: 10.1038/nbt.2673). Technology for engineering site-specific enzymes with reduced off-target effects is therefore needed.

SUMMARY OF THE INVENTION

The reported toxicity of some engineered site-specific enzymes such as endonucleases is thought to be based on off-target DNA cleavage. Further, the activity of existing RNA-guided nucleases generally cannot be controlled at the molecular level, for example, to switch a nuclease from an "off" to an "on" state. Controlling the activity of nucleases and other site-specific enzymes suitable for nucleic acid manipulations or modifications could decrease the likelihood of incurring off-target effects. Some aspects of this disclosure provide strategies, compositions, systems, and methods to control the binding and/or enzymatic activity of RNA-programmable enzymes, such as Cas9 endonuclease, nickases, deaminases, recombinases, transcriptional activators and repressors, epigenetic modifiers variants and fusions thereof.

Accordingly, one aspect of the present disclosure provides Cas9 proteins (including fusions of Cas9 proteins and functional domains) comprising inteins, for example, ligand-dependent inteins. The presence of the intein inhibits one or more activities of the Cas9 proteins, for example, nucleic acid binding activity (e.g., target nucleic acid binding activity and/or gRNA binding activity), a nuclease activity, or another enzymatic activity (e.g., nucleic acid modifying activity, transcriptional activation and repression, etc.) for which the Cas9 protein (e.g., Cas9 fusion protein) is engineered to undertake (e.g., nuclease activity, nickase activity, recombinase activity, deaminase activity, transcriptional activator/repressor activity, epigenetic modification, etc.). In some embodiments, the Cas9 protein is a Cas9 nickase. The Cas9 fusions are typically between a nuclease inactivated Cas9 ("dCas") and one or more functional domains. The intein may be inserted into any location of a Cas9 protein, including one or more domains of a Cas9 protein or Cas9 fusion (including in a functional domain), such as the HNH nuclease domain or the RuvC nuclease domain. In some embodiments, the intein replaces amino acid residue Cys80, Ala127, Thr146, Ser219, Thr333, Thr519, Cys574, Thr622, Ser701, Ala728, Thr995, Ser1006, Ser1154, Ser1159, or Ser1274 in the Cas9 polypeptide sequence set forth as SEQ ID NO:2, in the dCas9 polypeptide sequence set forth as SEQ ID NO:5, or in the Cas9 nickase polypeptide sequence set forth as SEQ ID NO:4. In some embodiments, the intein replaces or is inserted at an amino acid residue that is within 5, within 10, within 15, or within 20 amino acid residues of Cys80, Ala127, Thr146, Ser219, Thr333, Thr519, Cys574, Thr622, Ser701, Ala728, Thr995, Ser1006, Ser1154, Ser1159, or Ser1274 in the Cas9 polypeptide sequence set forth as SEQ ID NO:2, in the dCas9 polypeptide sequence set forth as SEQ ID NO:5, or in the Cas9 nickase polypeptide sequence set forth as SEQ ID NO:4. the intein replaces amino acid residue Ala127, Thr146, Ser219, Thr519, or Cys574 in the Cas9 polypeptide sequence set forth as SEQ ID NO:2, in the dCas9 polypeptide sequence set forth as SEQ ID NO:5, or in the Cas9 nickase polypeptide sequence set forth as SEQ ID NO:4. Typically the intein is a ligand-dependent intein which exhibits no or minimal protein splicing activity in the absence of ligand (e.g., small molecules such as 4-hydroxytamoxifen, peptides, proteins, polynucleotides, amino acids, and nucleotides). Ligand-dependent inteins are known, and include those described in U.S. patent application U.S. Ser. No. 14/004,280, published as U.S. 2014/0065711 A1, the entire contents of which are incorporated herein by reference. In some embodiments, the intein comprises an amino acid sequence selected from the group consisting of SEQ ID NO:7-14.

In one aspect, a Cas9 protein is provided that comprises: (i) a nuclease-inactivated Cas9 (e.g., dCas9 (SEQ ID NO:5)) domain; (ii) a ligand-dependent intein; and (iii) a recombinase catalytic domain. In some embodiments, the ligand-dependent intein domain is inserted into the dCas9 domain as described herein. Typically, the presence of the intein in the Cas9 protein inhibits one or more activities of the Cas9 protein, such as gRNA binding activity, target nucleic acid binding activity, and/or recombinase activity. Accordingly, upon self-excision of the intein (e.g., induced by ligand binding the intein) the one or more activities of the Cas9 protein is/are restored. In some embodiments, the recombinase catalytic domain is a monomer of the recombinase catalytic domain of Hin recombinase, Gin recombinase, or Tn3 recombinase.

According to another aspect, a Cas9 protein is provided that comprises: (i) a nuclease-inactivated Cas9 (e.g., dCas9 (SEQ ID NO:5)) domain; (ii) a ligand-dependent intein; and (iii) a deaminase catalytic domain. In some embodiments, the ligand-dependent intein domain is inserted into the dCas9 domain as described herein. Typically, the presence of the intein in the Cas9 protein inhibits one or more activities of the Cas9 protein, such as gRNA binding activity, target nucleic acid binding activity, and/or deaminase activity. Accordingly, upon self-excision of the intein (e.g., induced by ligand binding of the intein) the one or more activities of the Cas9 protein is/are restored. In some embodiments, the deaminase catalytic domain comprises a cytidine deaminase (e.g., of apolipoprotein B mRNA-editing complex (APOBEC) family deaminases such as APOBEC1 or activation-induced cytidine deaminase (AID)). In some embodiments, the deaminase catalytic domain comprises a ACF1/ASE deaminase or an adenosine deaminase, such as a ADAT family deaminase.

According to another aspect, a Cas9 protein is provided that comprises: (i) a nuclease-inactivated Cas9 (e.g., dCas9 (SEQ ID NO:5)) domain; (ii) a ligand-dependent intein; and (iii) a transcriptional activator domain. In some embodiments, the ligand-dependent intein domain is inserted into the dCas9 domain as described herein. Typically, the presence of the intein in the Cas9 protein inhibits one or more activities of the Cas9 protein, such as gRNA binding activity, target nucleic acid binding activity, and/or transcriptional activation. Accordingly, upon self-excision of the intein (e.g., induced by ligand binding the intein) the one or more activities of the Cas9 protein is/are restored. In some embodiments, the transcriptional activator domain is VP64, CP16, and p65.

According to yet another aspect, a Cas9 protein is provided that comprises: (i) a nuclease-inactivated Cas9 (e.g., dCas9 (SEQ ID NO:5)) domain; (ii) a ligand-dependent intein; and (iii) a transcriptional repressor domain. In some embodiments, the ligand-dependent intein domain is inserted into the dCas9 domain as described herein. Typically, the presence of the intein in the Cas9 protein inhibits one or more activities of the Cas9 protein, such as gRNA binding activity, target nucleic acid binding activity, and/or transcriptional repression. Accordingly, upon self-excision of the intein (e.g., induced by ligand binding the intein) the one or more activities of the Cas9 protein is/are restored. In some embodiments, the transcriptional repressor domain is KRAB, SID, or SID4x. According to yet another aspect, a Cas9 protein is provided that comprises: (i) a nuclease-inactivated Cas9 (e.g., dCas9 (SEQ ID NO:5)) domain; (ii) a ligand-dependent intein; and (iii) an epigenetic modifier domain. In some embodiments, the ligand-dependent intein domain is inserted into the dCas9 domain as described herein. Typically, the presence of the intein in the Cas9 protein inhibits one or more activities of the Cas9 protein, such as gRNA binding activity, target nucleic acid binding activity, and/or epigenetic modification activity. Accordingly, upon self-excision of the intein (e.g., induced by ligand binding the intein) the one or more activities of the Cas9 protein is/are restored. In some embodiments, the epigenetic modifier domain is epigenetic modifier is selected from the group consisting of histone demethylase, histone methyltransferase, hydroxylase, histone deacetylase, and histone acetyltransferase. In some embodiments, the epigenetic modifier comprises the LSD1 histone demethylase or TET1 hydroxylase.

According to another aspect, methods of using Cas9 proteins are provided. In some embodiments involving site-specific DNA cleavage, the methods comprise (a) contacting a Cas9 protein (e.g., having nuclease activity) comprising a ligand-dependent intein with a ligand, wherein binding of the ligand to the intein induces self-excision of the intein; and (b) contacting a DNA with the Cas9 protein, wherein the Cas9 protein is associated with a gRNA; whereby self-excision of the intein from the Cas9 protein in step (a) allows the Cas9 protein to cleave the DNA, thereby producing cleaved DNA. In some embodiments, the Cas9 protein first binds a gRNA and optionally the target DNA prior to excision of the intein, but is unable to cleave the DNA until excision of the intein occurs. Any of the Cas9 proteins having nuclease activity and comprising a ligand-dependent intein, as described herein, can be used in the inventive methods.

According to another aspect, methods of using any of the ligand-dependent intein-containing Cas9 proteins comprising a recombinase catalytic domain are provided. In some embodiments, the method is useful for recombining two nucleic acids, such as two DNAs, and comprises (a) contacting a first DNA with a first ligand-dependent dCas9-recombinase fusion protein (e.g., any of those described herein), wherein the dCas9 domain of the first fusion protein binds a first gRNA that hybridizes to a region of the first DNA; (b) contacting the first DNA with a second ligand-dependent dCas9-recombinase fusion protein, wherein the dCas9 domain of the second fusion protein binds a second gRNA that hybridizes to a second region of the first DNA; (c) contacting a second DNA with a third ligand-dependent dCas9-recombinase fusion protein, wherein the dCas9 domain of the third fusion protein binds a third gRNA that hybridizes to a region of the second DNA; and (d) contacting the second DNA with a fourth ligand-dependent dCas9-recombinase fusion protein, wherein the dCas9 domain of the fourth fusion protein binds a fourth gRNA that hybridizes to a second region of the second DNA; whereby the binding of the fusion proteins in steps (a)-(d) results in the tetramerization of the recombinase catalytic domains of the fusion proteins, under conditions such that the DNAs are recombined. In some embodiments, the methods are useful for site-specific recombination between two regions of a single DNA molecule, and comprise (a) contacting the DNA with a first ligand-dependent dCas9-recombinase fusion protein, wherein the dCas9 domain if the first fusion protein binds a first gRNA that hybridizes to a region of the DNA; (b) contacting the DNA with a second ligand-dependent dCas9-recombinase fusion protein, wherein the dCas9 domain of the second fusion protein binds a second gRNA that hybridizes to a second region of the DNA; (c) contacting the DNA with a third ligand-dependent dCas9-recombinase fusion protein, wherein the dCas9 domain of the third fusion protein binds a third gRNA that hybridizes to a third region of the DNA; (d) contacting the DNA with a fourth ligand-dependent dCas9-recombinase fusion protein, wherein the dCas9 domain of the fourth fusion protein binds a fourth gRNA that hybridizes to a fourth region of the DNA;

whereby the binding of the fusion proteins in steps (a)-(d) results in the tetramerization of the recombinase catalytic domains of the fusion proteins, under conditions such that the DNA is recombined. In some embodiment, any of the methods first comprise contacting the fusion proteins with a ligand that induces self-excision of the intein. In some embodiments, the fusion proteins are contacted with the ligand after: (i) the fusion proteins bind a gRNA; (ii) the fusion proteins bind the DNA; or (iii) after the recombinase domains form a tetramer. In some embodiments, the gRNAs in any step (a)-(d) of the inventive methods hybridize to the same strand or to opposing strands in the DNA(s). In some embodiments, the gRNAs hybridize to regions of their respective DNAs that are no more than 10, no more than 15, no more than 20, no more than 25, no more than 30, no more than 40, no more than 50, no more than 60, no more than 70, no more than 80, no more than 90, or no more than 100 base pairs apart.

According to yet another aspect, methods of using any of the ligand-dependent intein Cas9 proteins comprising deaminase catalytic domains are provided. The methods comprise contacting a DNA molecule with (a) a ligand-dependent Cas9 protein comprising deaminase catalytic domain as provided herein; and (b) a gRNA targeting the Cas9 protein of step (a) to a target nucleotide sequence of the DNA strand; wherein the DNA molecule is contacted with the Cas9 protein, and the gRNA in an amount effective and under conditions suitable for the deamination of a nucleotide base. In some embodiments, the methods comprise contacting the Cas9 protein with a ligand that induces self-excision of the intein either before or after the Cas9 protein binds the gRNA. In some embodiments, the target DNA sequence comprises a sequence associated with a disease or disorder, and wherein the deamination of the nucleotide base results in a sequence that is not associated with a disease or disorder. In some embodiments, the DNA sequence to be modified comprises a T→C or A→G point mutation associated with a disease or disorder, and the deamination of the mutant C or G base results in a sequence that is not associated with a disease or disorder (e.g., the deamination corrects the mutation the caused the disease or disorder). In some embodiments, the deamination corrects a point mutation in the sequence associated with the disease or disorder. In some embodiments, the sequence associated with the disease or disorder encodes a protein, and wherein the deamination introduces a stop codon into the sequence associated with the disease or disorder, resulting in a truncation of the encoded protein. In some embodiments, the deamination corrects a point mutation in the PI3KCA gene, thus correcting an H1047R and/or a A3140G mutation. In some embodiments, the contacting is performed in vivo in a subject susceptible to having or diagnosed with the disease or disorder. In some embodiments, the disease or disorder is a disease associated with a point mutation, or a single-base mutation, in the genome. In some embodiments, the disease is a genetic disease, a cancer, a metabolic disease, or a lysosomal storage disease.

According to another aspect, methods for transcriptional activation of a gene are provided. In some embodiments, the methods comprise contacting a DNA molecule comprising a gene with (a) a ligand-dependent dCas9 fusion protein comprising a transcriptional activator (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the transcriptional activation of the gene. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene.

According to another aspect, methods for transcriptional repression of a gene are provided. In some embodiments, the methods comprise contacting a DNA molecule comprising a gene with (a) a ligand-dependent dCas9 fusion protein comprising a transcriptional repressor (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the transcriptional repression of the gene. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene.

According to another aspect, methods for epigenetic modification of DNA are provided. In some embodiments, the DNA is chromosomal DNA. In some embodiments, the methods comprise contacting a DNA molecule with (a) a ligand-dependent dCas9 fusion protein comprising a epigenetic modifier (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the epigenetic modification of the DNA. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene in the DNA.

Any of the methods provided herein can be performed on DNA in a cell, for example, a cell in vitro or in vivo. In some embodiments, any of the methods provided herein are performed on DNA in a eukaryotic cell. In some embodiments, the eukaryotic cell is in an individual, for example, a human.

According to some embodiments, polynucleotides are provided, for example, that encode any of the proteins (e.g., proteins comprising ligand-dependent Cas9 proteins or variants) described herein. In some embodiments, vectors that comprise a polynucleotide described herein are provided. In some embodiments, vectors for recombinant expression of any of the proteins (e.g., comprising ligand-dependent Cas9 proteins or variants) described herein are provided. In some embodiments, cells comprising genetic constructs for expressing any of the proteins (e.g., comprising ligand-dependent Cas9 proteins or variants) described herein are provided.

In some embodiments, kits useful in using, producing, or creating any of the ligand-dependent Cas9 proteins or variants thereof, as described herein, are provided. For example, kits comprising any of the proteins (e.g., ligand-dependent Cas9 proteins or variants) described herein are provided. In some embodiments, kits comprising any of the polynucleotides described herein are provided. In some embodiments, kits comprising a vector for recombinant expression, wherein the vectors comprise a polynucleotide encoding any of the proteins (e.g., ligand-dependent Cas9 proteins or variants) described herein, are provided. In some embodiments, kits comprising a cell comprising genetic constructs for expressing any of the proteins (e.g., ligand-dependent Cas9 proteins or variants) described herein are provided.

Other advantages, features, and uses of the invention will be apparent from the Detailed Description of Certain Embodiments of the Invention; the Drawings, which are schematic and not intended to be drawn to scale; and the Claims.

DEFINITIONS

Figure 1:
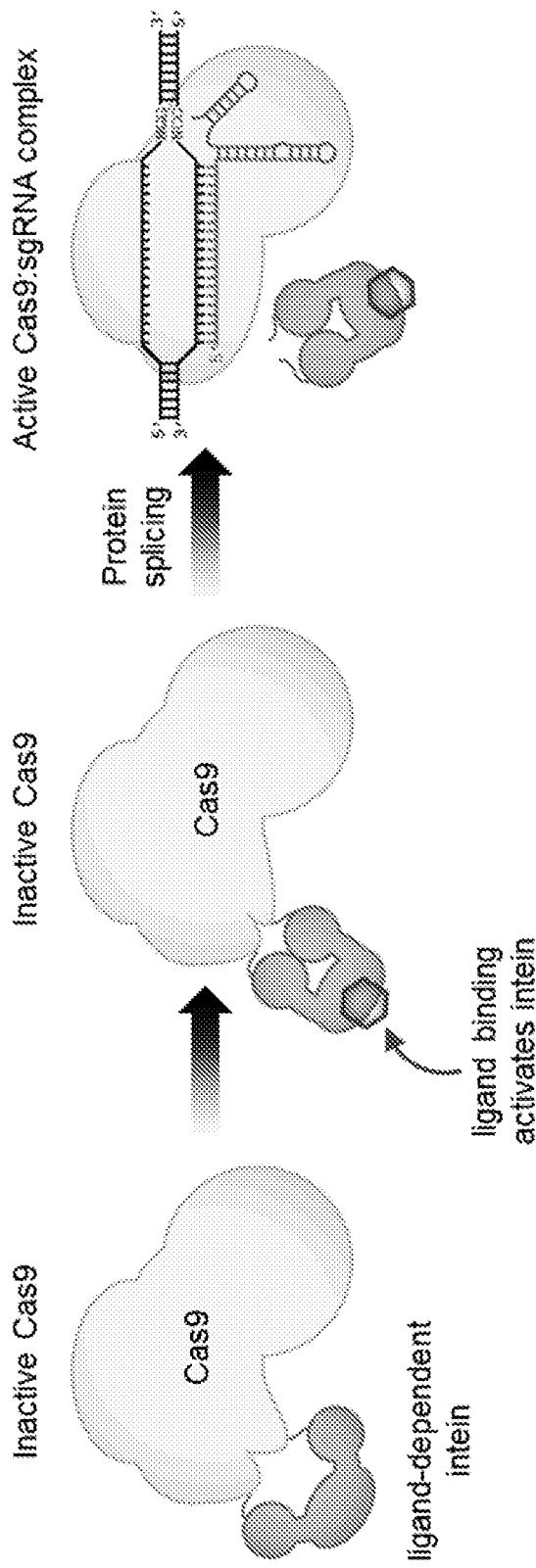
FIG. 1 shows a schematic depicting an exemplary embodiment of the disclosure. A Cas9 protein comprising a ligand-dependent intein, remains inactive in the absence of a ligand that binds the intein domain. Upon addition of the ligand, the intein is self-excised, restoring the activity of the Cas9 protein. Cas9 is then able to mediate RNA-guided cleavage of a DNA target sequence.

As used herein and in the claims, the singular forms "a," "an," and "the" include the singular and the plural reference unless the context clearly indicates otherwise. Thus, for example, a reference to "an agent" includes a single agent and a plurality of such agents.

The term "Cas9" or "Cas9 nuclease" refers to an RNA-guided nuclease comprising a Cas9 protein, or a fragment thereof. A Cas9 nuclease is also referred to sometimes as a casn1 nuclease or a CRISPR (clustered regularly interspaced short palindromic repeat)-associated nuclease. CRISPR is a prokaryotic adaptive immune system that provides protection against mobile genetic elements (e.g., viruses, transposable elements, and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc), and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'→5' exonucleolytically. In nature, DNA-binding and cleavage typically requires protein and both RNA species. However, single guide RNAs ("sgRNA", or simply "gNRA") can be engineered so as to incorporate aspects of both the crRNA and tracrRNA into a single RNA molecule. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L. expand/collapse author list McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, proteins comprising Cas9 proteins or fragments thereof are referred to as "Cas9 variants." A Cas9 variant shares homology to Cas9, or a fragment thereof. For example, a Cas9 variant may be at least about 70% identical, at least about 80% identical, at least about 90% identical, at least about 95% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain, an N-terminal domain or a C-terminal domain, etc.), such that the fragment is at least about 70% identical, at least about 80% identical, at least about 90% identical, at least about 95% identical, at least about 98% identical, at least about 99% identical, at least about 99.5% identical, or at least about 99.9% to the corresponding fragment of wild type Cas9. In some embodiments, wild type Cas9 corresponds to Cas9 from *Streptococcus pyogenes* (NCBI Reference Sequences: NC_017053.1 and NC_002737.1). In some embodiments, wild type Cas9 corresponds to SEQ ID NO:1 (nucleotide); SEQ ID NO:2 (amino acid)). In some embodiments, Cas9 corresponds to a human codon optimized sequence of Cas9 (e.g., SEQ ID NO:3; See, e.g., Fu et al. High-frequency off-target mutagenesis induced by CRISPR-Cas nucleases in human cells. *Nat. Biotechnol.* 2013; 31, 822-826). In some embodiments, a Cas9 nuclease has an inactive (e.g., an inactivated) DNA cleavage domain. A nuclease-inactivated Cas9 protein may also be referred to as a "dCas9" protein (for nuclease "dead" Cas9). In some embodiments, dCas9 corresponds to, or comprises in part or in whole, the amino acid set forth as SEQ ID NO:5, below. In some embodiments, variants of dCas9 (e.g., variants of SEQ ID NO:5) are provided. For example, in some embodiments, variants having mutations other than D10A and H840A are provided, which e.g., result in a nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, a Cas9 protein variant is a Cas9 nickase, which includes a mutation which abolishes the nuclease activity of one of the two nuclease domains of the protein. In some embodiments, a Cas9 nickase has one, but not both of a D10A and H840A substitution. In some embodiments, a Cas9 nickase corresponds to, or comprises in part or in whole, the amino acid set forth as SEQ ID NO:4, below. In some embodiments, variants or homologues of dCas9 or Cas9 nickase are provided which are at least about 70% identical, at least about 80% identical, at least about 90% identical, at least about 95% identical, at least about 98% identical, at least about 99% identical, at least about 99.5% identical, or at least about 99.9% to SEQ ID NO:5 or SEQ ID NO:4, respectively. In some embodiments, variants of dCas9 or Cas9 nickase (e.g., variants of SEQ ID NO:5 and SEQ ID NO:4, respectively) are provided having amino acid sequences which are shorter, or longer than SEQ ID NO:5 or SEQ ID NO:4, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

```
Cas9; nucleotide (Streptococcus pyogenes)
                                      (SEQ ID NO: 1)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT
```

```
CTTTTATTTGGCAGTGGAGAGACAGCGGAAGCGACTCGTCTCAAACGGAC
AGCTCGTAGAAGGTATACACGTCGGAAGAATCGTATTTGTTATCTACAGG
AGATTTTTTCAAATGAGATGGCGAAAGTAGATGATAGTTTCTTTCATCGA
CTTGAAGAGTCTTTTTTGGTGGAAGAAGACAAGAAGCATGAACGTCATCC
TATTTTTGGAAATATAGTAGATGAAGTTGCTTATCATGAGAAATATCCAA
CTATCTATCATCTGCGAAAAAAATTGGCAGATTCTACTGATAAAGCGGAT
TTGCGCTTAATCTATTTGGCCTTAGCGCATATGATTAAGTTTCGTGGTCA
TTTTTTTGATTGAGGGAGATTTAAATCCTGATAATAGTGATGTGGACAAAC
TATTTATCCAGTTGGTACAAATCTACAATCAATTATTTGAAGAAACCCT
ATTAACGCAAGTAGAGTAGATGCTAAAGCGATTCTTTCTGCACGATTGAG
TAAATCAAGACGATTAGAAAATCTCATTGCTCAGCTCCCCGGTGAGAAGA
GAAATGGCTTGTTTGGGAATCTCATTGCTTTGTCATTGGGATTGACCCCT
AATTTTAAATCAAATTTTGATTTGGCAGAAGATGCTAAATTACAGCTTTC
AAAAGATACTTACGATGATGATTTAGATAATTTATTGGCGCAAATTGGAG
ATCAATATGCTGATTTGTTTTGGCAGCTAAGAATTTATCAGATGCTATT
TTACTTTCAGATATCCTAAGAGTAAATAGTGAAATAACTAAGGCTCCCCT
ATCAGCTTCAATGATTAAGCGCTACGATGAACATCATCAAGACTTGACTC
TTTTAAAAGCTTTAGTTCGACAACAACTTCCAGAAAAGTATAAAGAAATC
TTTTTTGATCAATCAAAAAACGGATATGCAGGTTATATTGATGGGGGAGC
TAGCCAAGAAGAATTTTATAAATTTATCAAACCAATTTTAGAAAAAATGG
ATGGTACTGAGGAATTATTGGTGAAACTAAATCGTGAAGATTTGCTGCGC
AAGCAACGGACCTTTGACAACGGCTCTATTCCCCATCAAATTCACTTGGG
TGAGCTGCATGCTATTTTGAGAAGACAAGAAGACTTTTATCCATTTTTAA
AAGACAATCGTGAGAAGATTGAAAAAATCTTGACTTTTCGAATTCCTTAT
TATGTTGGTCCATTGGCGCGTGGCAATAGTCGTTTTGCATGGATGACTCG
GAAGTCTGAAGAAACAATTACCCCATGGAATTTTGAAGAAGTTGTCGATA
AAGGTGCTTCAGCTCAATCATTTATTGAACGCATGACAAACTTTGATAAA
AATCTTCCAAATGAAAAGTACTACCAAAACATAGTTTGCTTTATGAGTA
TTTTACGGTTTATAACGAATTGACAAAGGTCAAATATGTTACTGAGGGAA
TGCGAAAACCAGCATTTCTTTCAGGTGAACAGAAGAAAGCCATTGTTGAT
TTACTCTTCAAAACAAATCGAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGCGCCTACCATGATTTGCTAAAAATT
ATTAAAGATAAAGATTTTTTGGATAATGAAGAAAATGAAGATATCTTAGA
GGATATTGTTTAACATTGACCTTATTTGAAGATAGGGGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGATATTCAAAAAGCACAGGTGTCTGGACAAGG
CCATAGTTTACATGAACAGATTGCTAACTTAGCTGGCAGTCCTGCTATTA
AAAAAGGTATTTTACAGACTGTAAAAATTGTTGATGAACTGGTCAAAGTA
ATGGGCATAAGCCAGAAAATATCGTTATTGAAATGGCACGTGAAAATCA
GACAACTCAAAAGGGCCAGAAAAATTCGCGAGAGCGTATGAAACGAATCG
AAGAAGGTATCAAAGAATTAGGAAGTCAGATTCTTAAAGAGCATCCTGTT
GAAAATACTCAATTGCAAAATGAAAAGCTCTATCTCTATTATCTACAAAA
TGGAAGAGACATGTATGTGGACCAAGAATTAGATATTAATCGTTTAAGTG
ATTATGATGTCGATCACATTGTTCCACACAAGTTTCATTAAAGACGATTCA
ATAGACAATAAGGTACTAACGCGTTCTGATAAAAATCGTGGTAAATCGGA
TAACGTTCCAAGTGAAGAAGTAGTCAAAAAGATGAAAAACTATTGGAGAC
AACTTCTAAACGCCAAGTTAATCACTCAACGTAAGTTTGATAATTTAACG
AAAGCTGAACGTGGAGGTTTGAGTGAACTTGATAAAGCTGGTTTTATCAA
ACGCCAATTGGTTGAAACTCGCCAAATCACTAAGCATGTGGCACAAATTT
TGGATAGTCGCATGAATACTAAATACGATGAAAATGATAAACTTATTCGA
GAGGTTAAAGTGATTACCTTAAAATCTAAATTAGTTTCTGACTTCCGAAA
AGATTTCCAATTCTATAAAGTACGTGAGATTAACAATTACCATCATGCCC
ATGATGCGTATCTAAATGCCGTCGTTGGAACTGCTTTGATTAAGAAATAT
CCAAAACTTGAATCGGAGTTTGTCTATGGTGATTATAAAGTTTATGATGT
TCGTAAAATGATTGCTAAGTCTGAGCAAGAAATAGGCAAAGCAACCGCAA
AATATTTCTTTTACTCTAATATCATGAACTTCTTCAAAACAGAAATTACA
CTTGCAAATGGAGAGATTCGCAAACGCCCTCTAATCGAAACTAATGGGGA
AACTGGAGAAATTGTCTGGGATAAAGGGCGAGATTTTGCCACAGTGCGCA
AAGTATTGTCCATGCCCCAAGTCAATATTGTCAAGAAAACAGAAGTACAG
ACAGGCGGATTCTCCAAGGAGTCAATTTTACCAAAAAGAAATTCGGACAA
GCTTATTGCTCGTAAAAAAGACTGGGATCCAAAAAAATATGGTGGTTTTG
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAAGACTTAATCATTAAACTACCTAAAATAT
AGTCTTTTTGAGTTAGAAAACGGTCGTAAACGGATGCTGGCTAGTGCCGG
AGAATTACAAAAAGGAAATGAGCTGGCTCTGCCAAGCAAATATGTGAATT
TTTTATATTTAGCTAGTCATTATGAAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA
ATACGTGAACAAGCAGAAAATATTATTCATTTATTTACGTTGACGAATCT
TGGAGCTCCCGCTGCTTTTAAATATTTTGATACAACAATTGATCGTAAAC
GATATACGTCTACAAAAGAAGTTTTAGATGCCACTCTTATCCATCAATCC
ATCACTGGTCTTTATGAAACACGCATTGATTTGAGTCAGCTAGGAGGTGA
CTGA
```

Cas9 (human codon optimized)

(SEQ ID NO: 3)
ATGGATAAAAAGTATTCTATTGGTTTAGACATCGGCACTAATTCCGTTGG

ATGGGCTGTCATAACCGATGAATACAAAGTACCTTCAAAGAAATTTAAGG

TGTTGGGGAACACAGACCGTCATTCGATTAAAAAGAATCTTATCGGTGCC

CTCCTATTCGATAGTGGCGAAACGGCAGAGGCGACTCGCCTGAAACGAAC

CGCTCGGAGAAGGTATACACGTCGCAAGAACCGAATATGTTACTTACAAG

AAATTTTTAGCAATGAGATGGCCAAAGTTGACGATTCTTTCTTTCACCGT

TTGGAAGAGTCCTTCCTTGTCGAAGAGGACAAGAAACATGAACGGCACCC

CATCTTTGGAAACATAGTAGATGAGGTGGCATATCATGAAAAGTACCCAA

CGATTTATCACCTCAGAAAAAGCTAGTTGACTCAACTGATAAAGCGGAC

CTGAGGTTAATCTACTTGGCTCTTGCCCATATGATAAAGTTCCGTGGGCA

CTTTCTCATTGAGGGTGATCTAAATCCGGACAACTCGGATGTCGACAAAC

TGTTCATCCAGTTAGTACAAACCTATAATCAGTTGTTTGAAGAGAACCCT

ATAAATGCAAGTGGCGTGGATGCGAAGGCTATTCTTAGCGCCCGCCTCTC

TAAATCCCGACGGCTAGAAAACCTGATCGCACAATTACCCGGAGAGAAGA

AAAATGGGTTGTTCGGTAACCTTATAGCGCTCTCACTAGGCCTGACACCA

AATTTTAAGTCGAACTTCGACTTAGCTGAAGATGCCAAATTGCAGCTTAG

TAAGGACACGTACGATGACGATCTCGACAATCTACTGGCACAAATTGGAG

ATCAGTATGCGGACTTATTTTGGCTGCCAAAAACCTTAGCGATGCAATC

CTCCTATCTGACATACTGAGAGTTAATACTGAGATTACCAAGGCGCCGTT

ATCCGCTTCAATGATCAAAAGGTACGATGAACATCACCAAGACTTGACAC

TTCTCAAGGCCCTAGTCCGTCAGCAACTGCCTGAGAAATATAAGGAAATA

TTCTTTGATCAGTCGAAAAACGGGTACGCAGGTTATATTGACGGCGGAGC

GAGTCAAGAGGAATTCTACAAGTTTATCAAACCCATATTAGAGAAGATGG

ATGGGACGGAAGAGTTGCTTGTAAAACTCAATCGCGAAGATCTACTGCGA

AAGCAGCGGACTTTCGACAACGGTAGCATTCCACATCAAATCCACTTAGG

CGAATTGCATGCTATACTTAGAAGGCAGGAGGATTTTTATCCGTTCCTCA

AAGACAATCGTGAAAAGATTGAGAAAATCCTAACCTTTCGCATACCTTAC

TATGTGGGACCCCTGGCCCGAGGGAACTCTCGGTTCGCATGGATGACAAG

AAAGTCCGAAGAAACGATTACTCCATGGAATTTTGAGGAAGTTGTCGATA

AAGGTGCGTCAGCTCAATCGTTCATCGAGAGGATGACCAACTTTGACAAG

AATTTACCGAACGAAAAGTATTGCCTAAGCACAGTTTACTTTACGAGTA

TTTCACAGTGTACAATGAACTCACGAAAGTTAAGTATGTCACTGAGGGCA

TGCGTAAACCCGCCTTTCTAAGCGGAGAACAGAAGAAAGCAATAGTAGAT

CTGTTATTCAAGACCAACCGCAAAGTGACAGTTAAGCAATTGAAAGAGGA

CTACTTTAAGAAAATTGAATGCTTCGATTCTGTCGAGATCTCCGGGGTAG

AAGATCGATTTAATGCGTCACTTGGTACGTATCATGACCTCCTAAAGATA

ATTAAAGATAAGGACTTCCTGGATAACGAAGAGAATGAAGATATCTTAGA

AGATATAGTGTTGACTCTTACCCTCTTTGAAGATCGGGAAATGATTGAGG

AAAGACTAAAAACATACGCTCACCTGTTCGACGATAAGGTTATGAAACAG

TTAAAGAGGCGTCGCTATACGGGCTGGGGACGATTGTCGCGGAAACTTAT

CAACGGGATAAGAGACAAGCAAAGTGGTAAAACTATTCTCGATTTTCTAA

AGAGCGACGGCTTCGCCAATAGGAACTTTATGCAGCTGATCCATGATGAC

TCTTTAACCTTCAAAGAGGATATACAAAAGGCACAGGTTTCCGGACAAGG

GGACTCATTGCACGAACATATTGCGAATCTTGCTGGTTCGCCAGCCATCA

AAAAGGGCATACTCCAGACAGTCAAAGTAGTGGATGAGCTAGTTAAGGTC

ATGGGACGTCACAAACCGGAAAACATTGTAATCGAGATGGCACGCGAAAA

TCAAACGACTCAGAAGGGGCAAAAAAACAGTCGAGAGCGGATGAAGAGAA

TAGAAGAGGGTATTAAAGAACTGGGCAGCCAGATCTTAAAGGAGCATCCT

GTGGAAAATACCCAATTGCAGAACGAGAAACTTTACCTCTATTACCTACA

AAATGGAAGGGACATGTATGTTGATCAGGAACTGGACATAAACCGTTTAT

CTGATTACGACGTCGATCACATTGTACCCCAATCCTTTTTGAAGGACGAT

TCAATCGACAATAAAGTGCTTACACGCTCGGATAAGAACCGAGGGAAAAG

TGACAATGTTCCAAGCGAGGAAGTCGTAAAGAAAATGAAGAACTATTGGC

GGCAGCTCCTAAATGCGAAACTGATAACGCAAAGAAAGTTCGATAACTTA

ACTAAAGCTGAGAGGGGTGGCTTGTCTGAACTTGACAAGGCCGGATTTAT

TAAACGTCAGCTCGTGGAAACCCGCCAAATCACAAAGCATGTTGCACAGA

TACTAGATTCCCGAATGAATACGAAATACGACGAGAACGATAAGCTGATT

CGGGAAGTCAAAGTAATCACTTTAAAGTCAAAATTGGTGTCGGACTTCAG

AAAGGATTTTCAATTCTATAAAGTTAGGGAGATAAATAACTACCACCATG

CGCACGACGCTTATCTTAATGCCGTCGTAGGGACCGCACTCATTAAGAAA

TACCCGAAGCTAGAAAGTGAGTTTGTGTATGGTGATTACAAAGTTTATGA

CGTCCGTAAGATGATCGCGAAAAGCGAACAGGAGATAGGCAAGGCTACAG

CCAAATACTTCTTTTATTCTAACATTATGAATTTCTTTAAGACGGAAATC

ACTCTGGCAAACGGAGAGATACGCAAACGACCTTTAATTGAAACCAATGG

GGAGACAGGTGAAATCGTATGGGATAAGGGCCGGGACTTCGCGACGGTGA

GAAAAGTTTTGTCCATGCCCCAAGTCAACATAGTAAAGAAAACTGAGGTG

CAGACCGGAGGGTTTTCAAAGGAATCGATTCTTCCAAAAAGGAATAGTGA

TAAGCTCATCGCTCGTAAAAAGGACTGGGACCCGAAAAAGTACGGTGGCT

TCGATAGCCCTACAGTTGCCTATTCTGTCCTAGTAGTGGCAAAAGTTGAG

AAGGGAAAATCCAAGAAACTGAAGTCAGTCAAAGAATTATTGGGGATAAC

GATTATGGAGCGCTCGTCTTTTGAAAAGAACCCCATCGACTTCCTTGAGG

CGAAAGGTTACAAGGAAGTAAAAAAGGATCTCATAATTAAACTACCAAAG

TATAGTCTGTTTGAGTTAGAAAATGGCCGAAAACGGATGTTGGCTAGCGC

CGGAGAGCTTCAAAAGGGGAACGAACTCGCACTACCGTCTAAATACGTGA

ATTTCCTGTATTTAGCGTCCCATTACGAGAAGTTGAAAGGTTCACCTGAA

GATAACGAACAGAAGCAACTTTTTGTTGAGCAGCACAAACATTATCTCGA

CGAAATCATAGAGCAAATTTCGGAATTCAGTAAGAGAGTCATCCTAGCTG

ATGCCAATCTGGACAAAGTATTAAGCGCATACAACAAGCACAGGGATAAA

CCCATACGTGAGCAGGCGGAAAATATTATCCATTTGTTTACTCTTACCAA

CCTCGGCGCTCCAGCCGCATTCAAGTATTTTGACACAACGATAGATCGCA

-continued

AACGATACACTTCTACCAAGGAGGTGCTAGACGCGACACTGATTCACCAA

TCCATCACGGGATTATATGAAACTCGGATAGATTTGTCACAGCTTGGGGG

TGAC

Cas9; amino acid (*Streptococcus pyogenes*)
(SEQ ID NO: 2)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEH

PVENTQLQNEKLYLYYLQNGRDMYVDQELDINRLSDYDVDHIVPQSFLK

DDSIDNKVLTRSDKNRGKSDNVPSEEVVKKMKNYWRQLLNAKLITQRKFD

NLTKAERGGLSELDKAGFIKRQLVETRQITKHVAQILDSRMNTKYDEN

DKLIREVKVITLKSKLVSDFRKDFQFYKVREINNYHHAHDAYLNAVVGTA

LIKKYPKLESEFVYGDYKVYDVRKMIAKSEQEIGKATAKYFFYSNIMNF

FKTEITLANGEIRKRPLIETNGETGEIVWDKGRDFATVRKVLSMPQVN

IVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEV

KKDLIIKLPKYSLFELENGRKRMLASAGELQKGNELALPSKYVNFLYLA

SHYEKLKGSPEDNEQKQLFVEQHKYLDEIIEQISEFSKRVILADANLD

KVLSAYNKHRDKPIREQAENIIHLFTLTNLGAPAAFKYFDTTIDRKRYT

STKEVLDATLIHQSITGLYETRIDLSQLGGD (single underline:
HNH domain; double underline: RuvC domain)

dCas9 (D10A and H840A)
(SEQ ID NO: 5)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

-continued

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (single underline: HNH domain;
double underline: RuvC domain)

Cas9 nickase (D10A) (amino acid sequence)
(SEQ ID NO: 4)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYY

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

-continued

```
RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD
```

Cas9 variants are provided comprising an intein (e.g., a ligand-dependent intein) inserted within the Cas9 sequence and may be referred to as small-molecule-controlled Cas9 or ligand-dependent Cas9. In some embodiments, the intein is inserted into any location (e.g., at any amino acid position) in Cas9. In some embodiments, the inserted intein sequence replaces one or more amino acids in Cas9. For example, in some embodiments the inserted intein sequence replaces any cysteine, any alanine, any threonine, or any serine in Cas9 or a Cas9 variant such as dCas9 or Cas9 nickase. In some embodiments the inserted intein sequence replaces Cys80, Ala127, Thr146, Ser219, Thr333, Thr519, Cys574, Thr622, Ser701, Ala728, Thr995, Ser1006, Ser1154, Ser1159, or Ser1274 in Cas9 (SEQ ID NO:2), dCas9 (SEQ ID NO:5), or Cas9 nickase (SEQ ID NO:4).

The terms "conjugating," "conjugated," and "conjugation" refer to an association of two entities, for example, of two molecules such as two proteins, two domains (e.g., a binding domain and a cleavage domain), or a protein and an agent, e.g., a ligand binding domain and a small molecule. In some aspects, the association is between a protein (e.g., RNA-programmable nuclease) and a nucleic acid (e.g., a guide RNA). The association can be, for example, via a direct or indirect (e.g., via a linker) covalent linkage. In some aspects, the association is between two or more proteins, for example, an RNA-programmable nuclease (e.g., Cas9) and an intein protein. In some embodiments, the association is covalent. In some embodiments, two molecules are conjugated via a linker connecting both molecules.

The term "consensus sequence," as used herein in the context of nucleic acid sequences, refers to a calculated sequence representing the most frequent nucleotide residues found at each position in a plurality of similar sequences. Typically, it represents the results of a multiple sequence alignments in which related sequences are compared to each other and similar sequence motifs are calculated. Methods and software for determining a consensus sequence are known in the art (See, e.g., JalCiew (jalview.org); and UGENE; Okonechnikov, K.; Golosova, O.; Fursov, M.; the UGENE team. "Unipro UGENE: a unified bioinformatics toolkit". *Bioinformatics.* 2012; doi:10.1093/bioinformatics/bts091).

The term "deaminase" refers to an enzyme that catalyzes a deamination reaction. In some embodiments, the deaminase is a cytidine deaminase, catalyzing the hydrolytic deamination of cytidine or deoxycytidine to uracil or deoxyuracil, respectively.

The term "effective amount," as used herein, refers to an amount of a biologically active agent (e.g., a ligand-dependent Cas9) that is sufficient to elicit a desired biological response. For example, in some embodiments, an effective amount of a nuclease may refer to the amount of the nuclease that is sufficient to induce cleavage of a desired target site-specifically bound and cleaved by the nuclease, preferably with minimal or no off-target cleavage. In some embodiments, an effective amount of another ligand-dependent Cas9 protein having other nucleic acid modifying activities may refer to the amount of the protein that is sufficient to induce the nucleic acid modification. As will be appreciated by the skilled artisan, the effective amount of an agent, e.g., a ligand-dependent nuclease, deaminase, recombinase, nickase, or a hybrid protein, a fusion protein, a protein dimer, a complex of a protein (or protein dimer) and a polynucleotide, or a polynucleotide, may vary depending on various factors as, for example, on the desired biological response, the specific allele, genome, target site, cell, or tissue being targeted, and the agent being used.

The term "engineered," as used herein, refers to a nucleic acid molecule, a protein molecule, complex, substance, or entity that has been designed, produced, prepared, synthesized, and/or manufactured by a human. Accordingly, an engineered product is a product that does not occur in nature.

The term "epigenetic modifier," as used herein, refers to a protein or catalytic domain thereof having enzymatic activity that results in the epigenetic modification of DNA, for example, chromosomal DNA. Epigenetic modifications include, but are not limited to, DNA methylation and demethylation; histone modifications including methylation and demethylation (e.g., mono-, di- and tri-methylation), histone acetylation and deacetylation, as well as histone ubiquitylation, phosphorylation, and sumoylation.

The term "extein," as used herein, refers to an polypeptide sequence that is flanked by an intein and is ligated to another extein during the process of protein splicing to form a mature, spliced protein. Typically, an intein is flanked by two extein sequences that are ligated together when the intein catalyzes its own excision. Exteins, accordingly, are the protein analog to exons found in mRNA. For example, a polypeptide comprising an intein may be of the structure extein(N)-intein-extein(C). After excision of the intein and splicing of the two exteins, the resulting structures are extein(N)-extein(C) and a free intein.

The term "hybrid protein," as used herein, refers to a protein that comprises the amino acid sequence of a target protein (e.g., a Cas9 protein) and, embedded in that amino acid sequence, a ligand-dependent intein as described herein. Accordingly, a hybrid protein generally comprises the structure: target protein(N)-intein-target protein(C). Typically, a hybrid protein comprises a Cas9 protein (e.g., Cas9, Cas9 variants such as dCas9, fragments of Cas9 or Cas9 variants, etc.) and a ligand-dependent intein. In some embodiments, a hybrid protein is encoded by a recombinant nucleic acid, in which a nucleic acid sequence encoding an intein is inserted in frame into a nucleic acid sequence encoding a target protein. In certain embodiments, the target protein exhibits a desired activity or property that is absent or reduced in the hybrid protein. In some embodiments, excision of the intein from the hybrid protein results in a restoration of the desired activity or property in the mature, spliced target protein. Non-limiting examples of desired activities or properties of target proteins are binding activities, enzymatic activities (e.g., nuclease activities, gene editing activities, deaminase activities, recombinase activities), reporter activities (e.g., fluorescent activity), therapeutic activities, size, charge, hydrophobicity, hydrophilicity, or 3D-structure. In some embodiments, excision of the intein from a hybrid protein results in a mature, spliced target protein that exhibits the same or similar levels of a desired activity as the native target protein. A hybrid protein may be created from any target protein by embedding an intein sequence into the amino acid sequence of the target protein, for example, by generating a recombinant, hybrid protein-encoding nucleic acid molecule and subsequent transcription and translation, or by protein synthesis methods known to those of skill in the art.

The term "intein," as used herein, refers to an amino acid sequence that is able to excise itself from a protein and to rejoin the remaining protein segments (the exteins) via a peptide bond in a process termed protein splicing. Inteins are analogous to the introns found in mRNA. Many naturally occurring and engineered inteins and hybrid proteins comprising such inteins are known to those of skill in the art, and the mechanism of protein splicing has been the subject of extensive research. As a result, methods for the generation of hybrid proteins from naturally occurring and engineered inteins are well known to the skilled artisan. For an overview, see pages 1-10, 193-207, 211-229, 233-252, and 325-341 of Gross, Belfort, Derbyshire, Stoddard, and Wood (Eds.) *Homing Endonucleases and Inteins* Springer Verlag Heidelberg, 2005; ISBN 9783540251064; the contents of which are incorporated herein by reference for disclosure of inteins and methods of generating hybrid proteins comprising natural or engineered inteins. As will be apparent to those of skill in the art, an intein may catalyze protein splicing in a variety of extein contexts. Accordingly, an intein can be introduced into virtually any target protein sequence to create a desired hybrid protein, and the invention is not limited in the choice of target proteins.

The term "intein domain," as used herein, refers to the amino acid sequence of an intein that is essential for self-excision and extein ligation. For example, in some inteins, the entire intein amino acid sequence, or part(s) thereof, may constitute the intein domain, while in ligand-dependent inteins, the ligand-binding domain is typically embedded into the intein domain, resulting in the structure: intein domain (N)-ligand-binding domain-intein domain (C).

The term "ligand binding domain," as used herein, refers to a peptide or protein domain that binds a ligand. A ligand binding domain may be a naturally occurring domain or an engineered domain. Examples of ligand-binding domains referred to herein are the ligand binding domain of a native estrogen receptor, e.g., the ligand-binding domain of the native human estrogen receptor, and engineered, evolved, or mutated derivatives thereof. Other suitable ligand binding domains include the human thyroid hormone receptor (see, e.g., Skretas et al., "Regulation of protein activity with small-molecule-controlled inteins." *Protein Sci.* 2005; 14, 523-532) and members of the ribose-binding protein family (see, e.g., Björkman et al., "Multiple open forms of ribose-binding protein trace the path of its conformational change." *J Mol Biol.* 1998 12; 279(3):651-64). Typically, a ligand-binding domain useful in the context of ligand-dependent inteins, as provided herein, exhibits a specific three-dimensional structure in the absence of the ligand, which inhibits intein self-excision, and undergoes a conformational change upon binding of the ligand, which promotes intein self-excision. Some of the ligand-dependent inteins provided herein comprise a ligand-binding domain derived from the estrogen receptor that can bind 4-HT and other estrogen-receptor ligands, e.g., ligands described in more detail elsewhere herein, and undergo a conformational change upon binding of the ligand. An appropriate ligand may be any chemical compound that binds the ligand-binding domain and induces a desired conformational change. In some embodiments, an appropriate ligand is a molecule that is bound by the ligand-binding domain with high specificity and affinity. In some embodiments, the ligand is a small molecule. In some embodiments, the ligand is a molecule that does not naturally occur in the context (e.g., in a cell or tissue) that a ligand-dependent intein is used in. For example, in some embodiments, the ligand-binding domain is a ligand-binding domain derived from an estrogen receptor, and the ligand is tamoxifen, or a derivative or analog thereof (e.g., 4-hydroxytamoxifen, 4-HT).

The term "ligand-dependent intein," as used herein refers to an intein that comprises a ligand-binding domain. Typically, the ligand-binding domain is inserted into the amino acid sequence of the intein, resulting in a structure intein (N)-ligand-binding domain-intein (C). Typically, ligand-dependent inteins exhibit no or only minimal protein splicing activity in the absence of an appropriate ligand, and a marked increase of protein splicing activity in the presence of the ligand. In some embodiments, the ligand-dependent intein does not exhibit observable splicing activity in the absence of ligand but does exhibit splicing activity in the presence of the ligand. In some embodiments, the ligand-dependent intein exhibits an observable protein splicing activity in the absence of the ligand, and a protein splicing activity in the presence of an appropriate ligand that is at least 5 times, at least 10 times, at least 50 times, at least 100 times, at least 150 times, at least 200 times, at least 250 times, at least 500 times, at least 1000 times, at least 1500 times, at least 2000 times, at least 2500 times, at least 5000 times, at least 10000 times, at least 20000 times, at least 25000 times, at least 50000 times, at least 100000 times, at least 500000 times, or at least 1000000 times greater than the activity observed in the absence of the ligand. In some embodiments, the increase in activity is dose dependent over at least 1 order of magnitude, at least 2 orders of magnitude, at least 3 orders of magnitude, at least 4 orders of magnitude, or at least 5 orders of magnitude, allowing for fine-tuning of intein activity by adjusting the concentration of the ligand. Suitable ligand-dependent inteins are known in the art, and in include those provided below and those described in published U.S. Patent Application U.S. 2014/0065711 A1; Mootz et al., "Protein splicing triggered by a small molecule." *J. Am. Chem. Soc.* 2002; 124, 9044-9045; Mootz et al., "Conditional protein splicing: a new tool to control protein structure and function in vitro and in vivo." *J. Am. Chem. Soc.* 2003; 125, 10561-10569; Buskirk et al., *Proc. Natl. Acad. Sci. USA.* 2004; 101, 10505-10510); Skretas & Wood, "Regulation of protein activity with small-molecule-controlled inteins." *Protein Sci.* 2005; 14, 523-532; Schwartz, et al., "Post-translational enzyme activation in an animal via optimized conditional protein splicing." *Nat. Chem. Biol.* 2007; 3, 50-54; Peck et al., *Chem. Biol.* 2011; 18 (5), 619-630; the entire contents of each are hereby incorporated by reference.

2-4 intein:

(SEQ ID NO: 7)
CLAEGTRIFDPVTGTTHRIEDVVDGRKPIHVVAAAKDGTLLARPVVSWFD

QGTRDVIGLRIAGGAIVWATPDHKVLTEYGWRAAGELRKGDRVAGPGGSG

NSLALSLTADQMVSALLDAEPPILYSEYDPTSPFSEASMMGLLTNLADRE

LVHMINWAKRVPGFVDLTLHDQAHLLECAWLEILMIGLVWRSMEHPGKLL

-continued

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEELRYSVIREVLPTRRARTFDLEVEEL

HTLVAEGVVVHNC 3-2 intein:
(SEQ ID NO: 8)
CLAEGTRIFDPVTGTTHRIEDVVDGRKPIHVVAVAKDGTLLARPVVSWFD

QGTRDVIGLRIAGGAIVWATPDHKVLTEYGWRAAGELRKGDRVAGPGGSG

NSLALSLTADQMVSALLDAEPPILYSEYDPTSPFSEASMMGLLTNLADRE

LVHMINWAKRVPGFVDLTLHDQAHLLECAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYTNVVPLYDLLLEMLDAHRLHAGG

SGASRVQAFADALDDKFLHDMLAEELRYSVIREVLPTRRARTFDLEVEEL

HTLVAEGVVVHNC

30R3-1 intein:
(SEQ ID NO: 9)
CLAEGTRIFDPVTGTTHRIEDVVDGRKPIHVVAAAKDGTLLARPVVSWFD

QGTRDVIGLRIAGGATVWATPDHKVLTEYGWRAAGELRKGDRVAGPGGSG

NSLALSLTADQMVSALLDAEPPIPYSEYDPTSPFSEASMMGLLTNLADRE

LVHMINWAKRVPGFVDLTLHDQAHLLECAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEGLRYSVIREVLPTRRARTFDLEVEEL

HTLVAEGVVVHNC

30R3-2 intein:
(SEQ ID NO: 10)
CLAEGTRIFDPVTGTTHRIEDVVDGRKPIHVVAAAKDGTLLARPVVSWFD

QGTRDVIGLRIAGGATVWATPDHKVLTEYGWRAAGELRKGDRVAGPGGSG

NSLALSLTADQMVSALLDAEPPILYSEYDPTSPFSEASMMGLLTNLADRE

LVHMINWAKRVPGFVDLTLHDQAHLLECAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEELRYSVIREVLPTRRARTFDLEVEEL

HTLVAEGVVVHNC

30R3-3 intein:
(SEQ ID NO: 11)
CLAEGTRIFDPVTGTTHRIEDVVDGRKPIHVVAAAKDGTLLARPVVSWFD

QGTRDVIGLRIAGGATVWATPDHKVLTEYGWRAAGELRKGDRVAGPGGSG

NSLALSLTADQMVSALLDAEPPIPYSEYDPTSPFSEASMMGLLTNLADRE

LVHMINWAKRVPGFVDLTLHDQAHLLECAWLEILMIGLVWRSMEHPGKLL

FAPNLLLDRNQGKCVEGMVEIFDMLLATSSRFRMMNLQGEEFVCLKSIIL

-continued

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEELRYSVIREVLPTRRARTFDLEVEEL

HTLVAEGVVVHNC

37R3-1 intein:
(SEQ ID NO: 12)
CLAEGTRIFDPVTGTTHRIEDVVDGRKPIHVVAAAKDGTLLARPVVSWFD

QGTRDVIGLRIAGGATVWATPDHKVLTEYGWRAAGELRKGDRVAGPGGSG

NSLALSLTADQMVSALLDAEPPILYSEYNPTSPFSEASMMGLLTNLADRE

LVHMINWAKRVPGFVDLTLHDQAHLLERAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEGLRYSVIREVLPTRRARTFDLEVEEL

HTLVAEGVVVHNC

37R3-2 intein:
(SEQ ID NO: 13)
CLAEGTRIFDPVTGTTHRIEDVVDGRKPIHVVAAAKDGTLLARPVVSWFD

QGTRDVIGLRIAGGAIVWATPDHKVLTEYGWRAAGELRKGDRVAGPGGSG

NSLALSLTADQMVSALLDAEPPILYSEYDPTSPFSEASMMGLLTNLADRE

LVHMINWAKRVPGFVDLTLHDQAHLLERAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEGLRYSVIREVLPTRRARTFDLEVEEL

HTLVAEGVVVHNC

37R3-3 intein:
(SEQ ID NO: 14)
CLAEGTRIFDPVTGTTHRIEDVVDGRKPIHVVAVAKDGTLLARPVVSWFD

QGTRDVIGLRIAGGATVWATPDHKVLTEYGWRAAGELRKGDRVAGPGGSG

NSLALSLTADQMVSALLDAEPPILYSEYDPTSPFSEASMMGLLTNLADRE

LVHMINWAKRVPGFVDLTLHDQAHLLERAWLEILMIGLVWRSMEHPGKLL

FAPNLLLDRNQGKCVEGMVEIFDMLLATSSRFRMMNLQGEEFVCLKSIIL

LNSGVYTFLSSTLKSLEEKDHIHRALDKITDTLIHLMAKAGLTLQQQHQR

LAQLLLILSHIRHMSNKGMEHLYSMKYKNVVPLYDLLLEMLDAHRLHAGG

SGASRVQAFADALDDKFLHDMLAEELRYSVIREVLPTRRARTFDLEVEEL

HTLVAEGVVVHNC

The term "linker," as used herein, refers to a chemical group or a molecule linking two adjacent molecules or moieties, e.g., two polypeptides. Typically, the linker is positioned between, or flanked by, two groups, molecules, or other moieties and connected to each one via a covalent bond, thus connecting the two. In some embodiments, the linker is an amino acid linker. In some embodiments, the amino acid linker comprises at least 1, at least 2, at least 3, at least 4, at least 5, at least 6, at least 7, at least 8, at least 9, at least 10, at least 15, at least 20, at least 25, or at least 30 amino acids. In some embodiments, the linker is a divalent organic molecule, group, polymer, or chemical moiety. In some embodiments, the peptide linker comprises repeats of the tri-peptide Gly-Gly-Ser, e.g., comprising the sequence (GGS)$_n$, wherein n represents at least 1, 2, 3, 4, 5, 6, 7, 8, 9, 10, or more repeats. In some embodiments, the linker comprises the sequence (GGS)$_6$ (SEQ ID NO:15). In some embodiments, the peptide linker is the 16 residue "XTEN" linker, or a variant thereof (See, e.g., Schellenberger et al. A recombinant polypeptide extends the in vivo half-life of peptides and proteins in a tunable manner. *Nat. Biotechnol.* 27, 1186-1190 (2009)). In some embodiments, the XTEN linker comprises the sequence SGSETPGTSESATPES (SEQ ID NO:16), SGSETPGTSESA (SEQ ID NO:17), or SGSETPGTSESATPEGGSGGS (SEQ ID NO:18). In some embodiments, the peptide linker is one or more selected from VPFLLEPDNINGKTC (SEQ ID NO:19), GSAGSAAGSGEF (SEQ ID NO:20), SIVAQLSRPDPA (SEQ ID NO:21), MKIIEQLPSA (SEQ ID NO:22), VRHKLKRVGS (SEQ ID NO:23), GHGTGSTGSGSS (SEQ ID NO:24), MSRPDPA (SEQ ID NO:25); or GGSM (SEQ ID NO:26).

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Methods for making the amino acid substitutions (mutations) provided herein are known in the art and are provided by, for example, Green and Sambrook, *Molecular Cloning: A Laboratory Manual* (4th ed., Cold Spring Harbor Laboratory Press, Cold Spring Harbor, N.Y. (2012)).

The term "nuclease," as used herein, refers to an agent, for example, a protein, capable of cleaving a phosphodiester bond connecting two nucleotide residues in a nucleic acid molecule. In some embodiments, "nuclease" refers to a protein having an inactive DNA cleavage domain, such that the nuclease is incapable of cleaving a phosphodiester bond. In some embodiments, the nuclease is a protein, e.g., an enzyme that can bind a nucleic acid molecule and cleave a phosphodiester bond connecting nucleotide residues within the nucleic acid molecule. A nuclease may be an endonuclease, cleaving a phosphodiester bonds within a polynucleotide chain, or an exonuclease, cleaving a phosphodiester bond at the end of the polynucleotide chain. In some embodiments, a nuclease is a site-specific nuclease, binding and/or cleaving a specific phosphodiester bond within a specific nucleotide sequence, which is also referred to herein as the "recognition sequence," the "nuclease target site," or the "target site." In some embodiments, a nuclease is an RNA-guided (i.e., RNA-programmable) nuclease, which is associated with (e.g., binds to) an RNA (e.g., a guide RNA, "gRNA") having a sequence that complements a target site, thereby providing the sequence specificity of the nuclease. In some embodiments, a nuclease recognizes a single stranded target site. In some embodiments, a nuclease recognizes a double-stranded target site, for example, a double-stranded DNA target site. The target sites of many naturally occurring nucleases, for example, many naturally occurring DNA restriction nucleases, are well known to those of skill in the art. In many cases, a DNA nuclease, such as EcoRI, HindIII, or BamHI, recognize a palindromic, double-stranded DNA target site of 4 to 10 base pairs in length, and cut each of the two DNA strands at a specific position within the target site. Some endonucleases cut a double-stranded nucleic acid target site symmetrically, i.e., cutting both strands at the same position so that the ends comprise base-paired nucleotides, also referred to herein as blunt ends. Other endonucleases cut a double-stranded nucleic acid target site asymmetrically, i.e., cutting each strand at a different position so that the ends include unpaired nucleotides. Unpaired nucleotides at the end of a double-stranded DNA molecule are also referred to as "overhangs," e.g., as "5'-overhang" or as "3'-overhang," depending on whether the unpaired nucleotide(s) form(s) the 5' or the 5' end of the respective DNA strand. Double-stranded DNA molecule ends ending with unpaired nucleotide(s) are also referred to as sticky ends, as they can "stick to" other double-stranded DNA molecule ends comprising complementary unpaired nucleotide(s). A nuclease protein typically comprises a "binding domain" that mediates the interaction of the protein with the nucleic acid substrate, and also, in some cases, specifically binds to a target site, and a "cleavage domain" that catalyzes the cleavage of the phosphodiester bond within the nucleic acid backbone. In some embodiments, a nuclease protein can bind and cleave a nucleic acid molecule in a monomeric form. In some embodiments, a nuclease protein has to dimerize or multimerize in order to cleave a target nucleic acid. Binding domains and cleavage domains of naturally occurring nucleases, as well as modular binding domains and cleavage domains that can be fused to create nucleases binding specific target sites, are well known to those of skill in the art. For example, the binding domain of RNA-programmable nucleases (e.g., Cas9), or a Cas9 protein having an inactive DNA cleavage domain (e.g., dCas9), can be used as a binding domain (e.g., that binds a gRNA to direct binding to a target site) to specifically bind a desired target site, and fused or conjugated to a cleavage domain, for example, the cleavage domain of FokI, to create an engineered nuclease cleaving the target site. In some embodiments, Cas9 fusion proteins provided herein comprise the cleavage domain of FokI, and are therefore referred to as "fCas9" proteins. In some embodiments, the cleavage domain of FokI, e.g., in a fCas9 protein corresponds to, or comprises in part or whole, the amino acid sequence (or variants thereof) set forth as SEQ ID NO:6, below. In some embodiments, variants or homologues of the FokI cleavage domain include any variant or homologue capable of dimerizing (e.g., as part of fCas9 fusion protein) with another FokI cleavage domain at a target site in a target nucleic acid, thereby resulting in cleavage of the target nucleic acid. In some embodiments, variants of the FokI cleavage domain (e.g., variants of SEQ ID NO:6) are provided which are at least about 70% identical, at least about 80% identical, at least about 90% identical, at least about 95% identical, at least about 98% identical, at least about 99% identical, at least about 99.5% identical, or at least about 99.9% to SEQ ID NO:6. In some embodiments, variants of the FokI cleavage domain (e.g., variants of SEQ ID NO:6) are provided having an amino acid sequence which is shorter, or longer than SEQ ID NO:6, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more.

```
Cleavage domain of FokI:
                                         (SEQ ID NO: 6)
GSQLVKSELEEKKSELRHKLKYVPHEYIELIEIARNSTQDRILEMKVMEF

FMKVYGYRGKHLGGSRKPDGAIYTVGSPIDYGVIVDTKAYSGGYNLPIGQ
```

-continued

ADEMQRYVEENQTRNKHINPNEWWKVYPSSVTEFKFLFVSGHFKGNYKAQ

LTRLNHITNCNGAVLSVEELLIGGEMIKAGTLTLEEVRRKFNNGEINF

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, the term "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, i.e. analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "pharmaceutical composition," as used herein, refers to a composition that can be administered to a subject in the context of treatment of a disease or disorder. In some embodiments, a pharmaceutical composition comprises an active ingredient, e.g., a nuclease or a nucleic acid encoding a nuclease, and a pharmaceutically acceptable excipient.

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof.

The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site or a dCas9 protein) and a nucleic acid cleavage domain(s). In some embodiments, a protein is in a complex with, or is in association with, a nucleic acid, e.g., DNA or RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "protein splicing," as used herein, refers to a process in which a sequence, an intein, is excised from within an amino acid sequence, and the remaining fragments of the amino acid sequence, the exteins, are ligated via an amide bond to form a continuous amino acid sequence.

The term "RNA-programmable nuclease" and "RNA-guided nuclease" are used interchangeably herein and refer to a nuclease that forms a complex with (e.g., binds or associates with) one or more RNAs that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as an association of two or more RNAs, or as a single RNA molecule. gRNAs that exist as a single RNA molecule may be referred to as single-guide RNAs (sgRNAs), though "gRNA" is used interchangeably to refer to guide RNAs that exist as either a single molecule or as a complex of two or more molecules. Typically, gRNAs that exist as single RNA species comprise at least two domains: (1) a domain that shares homology to a target nucleic acid and may direct binding of a Cas9 complex to the target; and (2) a domain that binds a Cas9 protein. In some embodiments, domain (2) corresponds to a sequence known as a tracrRNA and comprises a stem-loop structure. For example, in some embodiments, domain (2) is homologous to a tracrRNA as depicted in FIG. 1E of Jinek et al., Science 337:816-821(2012), the entire contents of which is incorporated herein by reference. In some embodiments, domain 2 is at least 90%, at least 95%, at least 98%, or at least 99% identical to the tracrRNA as described by Jinek et al., Science 337:816-821(2012). The gRNA comprises a nucleotide sequence that complements a target site, which mediates binding of the nuclease/RNA complex to said target site and the sequence specificity of the nuclease:RNA complex. The sequence of a gRNA that binds a target nucleic acid can comprise any sequence that complements a region of the target and is suitable for a nuclease: RNA complex to bind. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L. expand/collapse author list McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to determine target DNA cleavage sites, these proteins are able to cleave, in principle, any sequence specified by the guide RNA. Methods of using RNA-programmable nucleases, such as Cas9, for site-specific cleavage (e.g., to modify a genome) are known in the art (see e.g., Cong et al. Multiplex genome engineering using CRISPR/Cas systems. *Science* 339, 819-823 (2013); Mali et al. RNA-guided human genome engineering via Cas9. *Science* 339, 823-826 (2013); Hwang et al. Efficient genome editing in zebrafish using a CRISPR-Cas system. *Nature biotechnology* 31, 227-229 (2013); Jinek et al. RNA-programmed genome editing in human cells. *eLife* 2, e00471 (2013); Dicarlo et al. Genome engineering in *Saccharomyces cerevisiae* using CRISPR-Cas systems. *Nucleic acids research* (2013); Jiang et al. RNA-guided editing of bacterial genomes using CRISPR-Cas systems. *Nature biotechnology* 31, 233-239 (2013); the entire contents of each of which are incorporated herein by reference).

The term "recombinase," as used herein, refers to a site-specific enzyme that mediates the recombination of DNA between recombinase recognition sequences, which results in the excision, integration, inversion, or exchange (e.g., translocation) of DNA fragments between the recombinase recognition sequences. Recombinases can be classified into two distinct families: serine recombinases (e.g., resolvases and invertases) and tyrosine recombinases (e.g., integrases). Examples of serine recombinases include, without limitation, Hin, Gin, Tn3, β-six, CinH, ParA, γδ, Bxb1, φC31, TP901, TG1, φBT1, R4, φRV1, φFC1, MR11, A118, U153, and gp29. Examples of tyrosine recombinases include, without limitation, Cre, FLP, R, Lambda, HK101, HK022, and pSAM2. The serine and tyrosine recombinase names stem from the conserved nucleophilic amino acid residue that the recombinase uses to attack the DNA and which becomes covalently linked to the DNA during strand exchange. Recombinases have numerous applications, including the creation of gene knockouts/knock-ins and gene therapy applications. See, e.g., Brown et al., "Serine recombinases as tools for genome engineering." *Methods.* 2011; 53(4):372-9; Hirano et al., "Site-specific recombinases as tools for heterologous gene integration." *Appl. Microbiol. Biotechnol.* 2011; 92(2):227-39; Chavez and Calos, "Therapeutic applications of the ΦC31 integrase system." *Curr. Gene Ther.* 2011; 11(5):375-81; Turan and Bode, "Site-specific recombinases: from tag-and-target-to tag-and-exchange-based genomic modifications." *FASEB J.* 2011; 25(12):4088-107; Venken and Bellen, "Genome-wide manipulations of *Drosophila melanogaster* with transposons, Flp recombinase, and (13C31 integrase." *Methods Mol. Biol.* 2012; 859:203-28; Murphy, "Phage recombinases and their applications." *Adv. Virus Res.* 2012; 83:367-414; Zhang et al., "Conditional gene manipulation: Cre-ating a new biological era." *J. Zhejiang Univ. Sci. B.* 2012; 13(7): 511-24; Karpenshif and Bernstein, "From yeast to mammals: recent advances in genetic control of homologous recombination." *DNA Repair (Amst).* 2012; 1; 11(10):781-8; the entire contents of each are hereby incorporated by reference in their entirety. The recombinases provided herein are not meant to be exclusive examples of recombinases that can be used in embodiments of the invention. The methods and compositions of the invention can be expanded by mining databases for new orthogonal recombinases or designing synthetic recombinases with defined DNA specificities (See, e.g., Groth et al., "Phage integrases: biology and applications." *J. Mol. Biol.* 2004; 335, 667-678; Gordley et al., "Synthesis of programmable integrases." *Proc. Natl. Acad. Sci. USA.* 2009; 106, 5053-5058; the entire contents of each are hereby incorporated by reference in their entirety). Other examples of recombinases that are useful in the methods and compositions described herein are known to those of skill in the art, and any new recombinase that is discovered or generated is expected to be able to be used in the different embodiments of the invention. In some embodiments, the catalytic domains of a recombinase are fused to a nuclease-inactivated RNA-programmable nuclease (e.g., dCas9, or a fragment thereof), such that the recombinase domain does not comprise a nucleic acid binding domain or is unable to bind to a target nucleic acid (e.g., the recombinase domain is engineered such that it does not have specific DNA binding activity). Recombinases lacking DNA binding activity and methods for engineering such are known, and include those described by Klippel et al., "Isolation and characterisation of unusual gin mutants." *EMBO J.* 1988; 7: 3983-3989: Burke et al., "Activating mutations of Tn3 resolvase marking interfaces important in recombination catalysis and its regulation. *Mol Microbiol.* 2004; 51: 937-948; Olorunniji et al., "Synapsis and catalysis by activated Tn3 resolvase mutants." *Nucleic Acids Res.* 2008; 36: 7181-7191; Rowland et al., "Regulatory mutations in Sin recombinase support a structure-based model of the synaptosome." *Mol Microbiol.* 2009; 74: 282-298; Akopian et al., "Chimeric recombinases with designed DNA sequence recognition." *Proc Natl Acad Sci USA.* 2003; 100: 8688-8691; Gordley et al., "Evolution of programmable zinc finger-recombinases with activity in human cells. *J Mol Biol.* 2007; 367: 802-813; Gordley et al., "Synthesis of programmable integrases." *Proc Natl Acad Sci USA.* 2009; 106: 5053-5058; Arnold et al., "Mutants of Tn3 resolvase which do not require accessory binding sites for recombination activity." *EMBO J.* 1999; 18: 1407-1414; Gaj et al., "Structure-guided reprogramming of serine recombinase DNA sequence specificity." *Proc Natl Acad Sci USA.* 2011; 108(2):498-503; and Proudfoot et al., "Zinc finger recombinases with adaptable DNA sequence specificity." *PLoS One.* 2011; 6(4):e19537; the entire contents of each are hereby incorporated by reference. For example, serine recombinases of the resolvase-invertase group, e.g., Tn3 and γδ resolvases and the Hin and Gin invertases, have modular structures with autonomous catalytic and DNA-binding domains (See, e.g., Grindley et al., "Mechanism of site-specific recombination." *Ann Rev Biochem.* 2006; 75: 567-605, the entire contents of which are incorporated by reference). The catalytic domains of these recombinases are thus amenable to being recombined with nuclease-inactivated RNA-programmable nucleases (e.g., dCas9, or a fragment thereof) as described herein, e.g., following the isolation of 'activated' recombinase mutants which do not require any accessory factors (e.g., DNA binding activities) (See, e.g., Klippel et al., "Isolation and characterisation of unusual gin mutants." *EMBO J.* 1988; 7: 3983-3989; Burke et al., "Activating mutations of Tn3 resolvase marking interfaces important in recombination catalysis and its regulation. *Mol Microbiol.* 2004; 51: 937-948; Olorunniji et al., "Synapsis and catalysis by activated Tn3 resolvase mutants." *Nucleic Acids Res.* 2008; 36: 7181-7191; Rowland et al., "Regulatory mutations in Sin recombinase support a structure-based model of the synaptosome." *Mol Microbiol.* 2009; 74: 282-298; Akopian et al., "Chimeric recombinases with designed DNA sequence recognition." *Proc Natl Acad Sci USA.* 2003; 100: 8688-8691). Additionally, many other natural serine recombinases having an N-terminal catalytic domain and a C-terminal DNA binding domain are known (e.g., phiC31 integrase, TnpX transposase, IS607 transposase), and their catalytic domains can be co-opted to engineer programmable site-specific recombinases as described herein (See, e.g., Smith et al., "Diversity in the serine recombinases." *Mol Microbiol.* 2002; 44: 299-307, the entire contents of which are incorporated by reference). Similarly, the core catalytic domains of tyrosine recombinases (e.g., Cre, λ integrase) are known, and can be similarly co-opted to engineer programmable site-specific recombinases as described herein (See, e.g., Guo et al., "Structure of Cre recombinase complexed with DNA in a site-specific recombination synapse." *Nature.* 1997; 389:40-46; Hartung et al., "Cre mutants with altered DNA binding properties." *J Biol Chem* 1998; 273:22884-22891; Shaikh et al., "Chimeras of the Flp and Cre recombinases: Tests of the mode of cleavage by Flp and Cre. *J Mol Biol.* 2000; 302:27-48; Rongrong et al., "Effect of deletion mutation on the recombination activity of Cre recombinase." *Acta Biochim Pol.* 2005; 52:541-544; Kilbride et al., "Determinants of product topology in a hybrid Cre-Tn3 resolvase site-specific recombination system." *J Mol Biol.* 2006; 355:185-195; Warren et al., "A chimeric cre recombinase with regulated directionality." *Proc Natl Acad Sci USA.* 2008 105:18278-18283; Van Duyne, "Teaching Cre to follow directions." *Proc Natl Acad Sci USA.* 2009 Jan. 6; 106(1):4-5; Numrych et al., "A comparison of the effects of single-base and triple-base changes in the integrase arm-type binding sites on the site-specific recombination of bacteriophage λ." *Nucleic Acids Res.* 1990; 18:3953-3959; Tirumalai et al., "The recognition of core-type DNA sites by λ integrase." *J Mol Biol.* 1998; 279:513-527; Aihara et al., "A conformational switch controls the DNA cleavage activity of λ integrase." *Mol Cell.* 2003; 12:187-198; Biswas et al., "A structural basis for allosteric control of DNA recombination by λ integrase." *Nature.* 2005; 435:1059-1066; and Warren et al., "Mutations in the amino-terminal domain of λ-integrase have differential effects on integrative and excisive recombination." *Mol Microbiol.* 2005; 55:1104-1112; the entire contents of each are incorporated by reference).

The term "recombine," or "recombination," in the context of a nucleic acid modification (e.g., a genomic modification), is used to refer to the process by which two or more nucleic acid molecules, or two or more regions of a single nucleic acid molecule, are modified by the action of a recombinase protein (e.g., an inventive recombinase fusion protein provided herein). Recombination can result in, inter alia, the insertion, inversion, excision, or translocation of nucleic acids, e.g., in or between one or more nucleic acid molecules.

The term "site-specific enzyme," as used herein, refers to any enzyme capable of binding a nucleic acid at a target site to mediate a modification of the nucleic acid. Typically, the site-specific enzymes provided herein comprise an intein (e.g., a ligand-dependent intein). In some embodiments, the site-specific enzyme is unable to bind a target site prior to excision of the intein. In some embodiments, the site-specific enzyme is able to bind a target site prior to excision of the intein but remains enzymatically inactive (e.g., cannot cleave, recombine, edit, or otherwise modify a nucleic acid) until excision of the intein.

The term "small molecule," as used herein, refers to a non-peptidic, non-oligomeric organic compound either prepared in the laboratory or found in nature. Small molecules, as used herein, can refer to compounds that are "natural product-like", however, the term "small molecule" is not limited to "natural product-like" compounds. Rather, a small molecule is typically a non-polymeric, non-oligomeric molecule that is characterized in that it contains several carbon-carbon bonds, and has a molecular weight of less than 2000 g/mol, preferably less than 1500 g/mol, although this characterization is not intended to be limiting for the purposes of the present invention. In certain embodiments, the ligand of a ligand-dependent inteins used in the present invention is a small molecule.

The term "subject," as used herein, refers to an individual organism. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The terms "target nucleic acid," and "target genome," as used herein in the context of nucleases, refer to a nucleic acid molecule or a genome, respectively, that comprises at least one target site of a given nuclease.

The term "target site," refers to a sequence within a nucleic acid molecule that is bound and (1) cleaved; (2) recombined; (3) edited; or (4) otherwise modified by a site-specific enzyme. In some embodiments, a target site refers to a "nuclease target site," which is a sequence within a nucleic acid molecule that is bound and cleaved by a nuclease. A target site may be single-stranded or double-stranded. In the context of RNA-guided (i.e., RNA-programmable) nucleases (e.g., a Cas9 protein, a Cas9 variant, fragments of Cas9 or fragments of Cas9 variants, etc.), a target site typically comprises a nucleotide sequence that is complementary to a gRNA of the RNA-guided nuclease, and a protospacer adjacent motif (PAM) at the 3' end adjacent to the gRNA-complementary sequence. For the RNA-guided nuclease Cas9, the target site may be, in some embodiments, 20 base pairs plus a 3 base pair PAM (e.g., NNN, wherein N represents any nucleotide). Typically, the first nucleotide of a PAM can be any nucleotide, while the two downstream nucleotides are specified depending on the specific RNA-guided nuclease. Exemplary target sites for RNA-guided nucleases, such as Cas9, are known to those of skill in the art and include, without limitation, NNG, NGN, NAG, and NGG, wherein N represents any nucleotide. In addition, Cas9 nucleases from different species (e.g., *S. thermophilus* instead of *S. pyogenes*) recognize a PAM that comprises the sequence: NGGNG. Additional PAM sequences are known, including, but not limited to, NNAGAAW and NAAR (see, e.g., Esvelt and Wang, *Molecular Systems Biology*, 9:641 (2013), the entire contents of which are incorporated herein by reference). For example, the target site of an RNA-guided nuclease, such as, e.g., Cas9, may comprise the structure [Nz]-[PAM], where each N is, independently, any nucleotide, and $z$ is an integer between 1 and 50. In some embodiments, $z$ is at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50. In some embodiments, $z$ is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50. In some embodiments, Z is 20. In some embodiments, "target site" may also refer to a sequence within a nucleic acid molecule that is bound but not cleaved by a nuclease.

The terms "transcriptional activator" and "transcriptional repressor," refer to agents which activate and repress the transcription of a gene, respectively. Typically, such activators and repressors are proteins, e.g., as provided herein.

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In some embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "vector" refers to a polynucleotide comprising one or more recombinant polynucleotides of the present invention, e.g., those encoding or a Cas9 protein (e.g., a Cas9 protein comprising an intein) and/or a gRNA provided herein. Vectors include, but are not limited to, plasmids, viral vectors, cosmids, artificial chromosomes, and phagemids. The vector is one which is able to replicate in a host cell, and which is further characterized by one or more endonuclease restriction sites at which the vector may be cut and into which a desired nucleic acid sequence may be inserted. Vectors may contain one or more marker sequences suitable for use in the identification and/or selection of cells which have or have not been transformed or genomically modified with the vector. Markers include, for example, genes encoding proteins which increase or decrease either resistance or sensitivity to antibiotics (e.g., kanamycin, ampicillin) or other compounds, genes which encode enzymes whose activities are detectable by standard assays known in the art (e.g., β-galactosidase, alkaline phosphatase or luciferase), and genes which visibly affect the phenotype of transformed or transfected cells, hosts, colonies, or plaques. Any vector suitable for the transformation of a host cell, (e.g., *E. coli*, mammalian cells such as CHO cell, insect cells, etc.) as embraced by the present invention, for example vectors belonging to the pUC series, pGEM series, pET series, pBAD series, pTET series, or pGEX series. In some embodiments, the vector is suitable for transforming a host cell for recombinant protein production. Methods for selecting and engineering vectors and host cells for expressing gRNAs and/or proteins (e.g., those provided herein), transforming cells, and expressing/purifying recombinant proteins are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

DETAILED DESCRIPTION OF CERTAIN EMBODIMENTS OF THE INVENTION

Site-specific enzymes which catalyze nucleic acid modifications are powerful tools for targeted genome modification in vitro and in vivo. Some site-specific enzymes can theoretically achieve a level of specificity for a target site that would allow one to target a single unique site in a genome for modification without affecting any other genomic site. In the case of site-specific nucleases, it has been reported that nuclease cleavage in living cells triggers a DNA repair mechanism that frequently results in a modification of the cleaved and repaired genomic sequence, for example, via homologous recombination or non-homologous end-joining. Accordingly, the targeted cleavage of a specific unique sequence within a genome opens up new avenues for gene targeting and gene modification in living cells, including cells that are hard to manipulate with conventional gene targeting methods, such as many human somatic cells or embryonic stem cells. Nuclease-mediated modification of disease-related sequences, e.g., the CCR-5 allele in HIV/AIDS patients, or of genes necessary for tumor neovascularization, can be used in the clinical context, and two site-specific nucleases are currently in clinical trials (Perez, E. E. et al., "Establishment of HIV-1 resistance in CD4+ T cells by genome editing using zinc-finger nucleases." *Nature Biotechnology*. 26, 808-816 (2008); ClinicalTrials.gov identifiers: NCT00842634, NCT01044654, NCT01252641, NCT01082926). Other diseases that can be treated using site-specific nucleases or other site-specific DNA modifying enzymes include, for example, diseases associated with triplet expansion (e.g., Huntington's disease, myotonic dystrophy, spinocerebellar atatxias, etc.), cystic fibrosis (by targeting the CFTR gene), cancer, autoimmune diseases, and viral infections.

One important problem with site-specific modification is off-target effects, e.g., the modification of genomic sequences that differ from the intended target sequence by one or more nucleotides. Undesired side effects of off-target modification range from insertion into unwanted loci during a gene targeting event to severe complications in a clinical scenario. For example, off-target modification of sequences encoding essential gene functions or tumor suppressor genes may result in disease or even the death of a subject. Accordingly, it is desirable to employ new strategies in designing site-specific enzymes having the greatest chance of minimizing off-target effects.

The systems, methods, and compositions of the present disclosure represent, in some aspects, an improvement over previous methods and compositions by providing means to control the spatiotemporal activity of site-specific enzymes, for example, RNA-guided nucleases and engineered RNA-guided nucleic acid modifying enzymes. For example, RNA-guided nucleases known in the art, both naturally occurring and those engineered, typically bind to and cleave DNA upon forming a complex with an RNA (e.g., a gRNA) that complements the target. Aspects of the present invention relate to the recognition that having spatiotemporal control of the enzymatic or nucleic acid binding properties of an RNA-guided nuclease and RNA-guided nucleic acid modifying enzymes by engineering variants to include an intein will decrease the likelihood of off-target effects by minimizing or controlling the time a RNA-guided nuclease or engineered RNA-guided nucleic acid modifying enzymes is active. Accordingly, the strategies, methods, compositions, kits, and systems provided herein can be used to control the activity of any site-specific enzyme (both naturally occurring and those engineered) such as RNA-guided nucleases (e.g., Cas9, Cas9 variants, fragments of Cas9 or Cas9 variants, etc.) or engineered nucleic acid modifying enzymes comprising a variant of an RNA-guided nuclease (e.g., dCas9).

Inteins are protein splicing elements that are able to catalyze their excision out of a single polypeptide and leave behind the flanking sequences, or exteins, precisely ligated together through a native peptide bond. Inteins are attractive tools for modulating protein structure and function because they do not require any other cellular components, are able to splice out of a wide variety of extein contexts, and can undergo splicing in minutes. Although natural inteins splice spontaneously, inteins that undergo splicing in a small molecule-dependent or ligand-dependent manner have been developed by fusing intein halves with proteins that dimerize in the presence of a small molecule, or by directed evolution in which a library of intact inteins fused to a ligand-binding domain was screened to splice in the presence, but not the absence, of a small molecule or ligand. These ligand-dependent inteins have enabled protein function in cells to be controlled post-translationally by the addition of an exogenous, cell-permeable molecule (See e.g., published U.S. Patent Application US 2014/0065711 A1, the entire contents of which are hereby incorporated by reference). The inventors have found that the targeted insertion of ligand-dependent inteins into site-specific enzymes renders the enzymes, in some instances, inactive prior to the controlled excision of the intein through binding of a ligand specific for the intein. For example, the targeted insertion of a ligand-dependent intein into Cas9 at fifteen different positions resulted in a subset of Cas9 variants that were inactive in the absence of ligand, but upon addition of the ligand the intein self-excised resulting in an active Cas9 protein capable of site-specific cleavage of a target gene.

Some aspects of this disclosure are based on the surprising discovery that Cas9 proteins comprising an intein, for example, a ligand-dependent intein as described herein, exhibit an increased specificity as compared to constitutively active Cas9 proteins. For example, it was found that the conditionally active Cas9 proteins comprising an intein exhibit an activity in the "on" state that is comparable to wild-type Cas9 activity or only slightly decreased as compared to wild-type Cas9 activity, while exhibiting decreased off-target activity.

In addition, some aspects of this disclosure relate to the recognition that Cas9 off-target activity is at least in part related to the concentration of active Cas9 proteins, and that the off-target activity of the provided conditionally active Cas9 proteins, e.g., the provided ligand-dependent Cas9 proteins, can be modulated, e.g., further decreased, by contacting the Cas9 proteins with a minimal amount of ligand effecting the desired result, e.g., the minimal amount effecting intein excision from a Cas9 protein, or the minimal amount resulting in a desired level of Cas9 protein activity.

While of particular relevance to DNA and DNA-cleaving nucleases such as Cas9 and variants thereof, the inventive concepts, methods, compositions, strategies, kits, and systems provided herein are not limited in this respect, but can be applied to any nuclease or nucleic acid:enzyme system utilizing nucleic acid templates such as RNA to direct binding to a target nucleic acid. For example, the inventive concepts provided herein can be applied to RNA-guided nucleic acid-targeting protein, e.g., to RNA-guided nucleases, and to fusion proteins comprising nucleic acid-targeting domains of such nucleases, e.g., to fusion proteins comprising a Cas9 targeting domain (e.g., dCas9 domain), and a functional (effector) domain, such as, for example, a heterologous nuclease domain, recombinase domain, or other nucleic acid-editing domain.

Small Molecule Controlled Site-Specific Enzymes

Some aspects of this disclosure provide site-specific enzymes engineered to have both an "on" and "off" state which depends on the presence of a ligand such as a small molecule. The ligand binds and activates the enzyme through binding a ligand-dependent intein in the enzyme, whereby ligand binding induces self-excision of the intein thereby activating the enzyme (e.g., the presence of the intein in the enzyme disrupted one or more activities of the enzyme). In some aspects then, the enzymes may collectively be referred to as "small molecule controlled" or "ligand-dependent" site-specific enzymes. In some embodiments, the site-specific enzyme that has been modified to include a ligand-dependent intein comprises Cas9, or a variant of Cas9.

Accordingly, in the absence of a ligand that binds the intein, the intein is not excised, and the protein comprising Cas9 or variant of Cas9 remains inactive. By "inactive" it is meant that the protein has no or minimal activity with respect to one or more activities described herein. In some embodiments, prior to intein excision, the protein has (i) no or minimal enzymatic activity; (ii) no or minimal gRNA binding activity; (iii) no or minimal target nucleic acid binding activity; or any combination of (i)-(iii), e.g., the protein has (i) and (ii); (i) and (iii); (ii) and (iii); or (i), (ii) and (iii). Enzymatic activities for (i), include, for example, nuclease activity, nickase activity, recombinase activity, nucleic acid editing (e.g., deaminase) activity, transcriptional activation, transcriptional repression, and epigenetic modification activity.

In some embodiments, by "minimal" activity, it is meant that the protein, prior to excision of the intein, exhibits less than 50%, less than 45%, less than 40%, less than 35%, less than 30%, less than 25%, less than 24%, less than 23%, less than 22%, less than 21%, less than 20, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, or less than 1% of a particular activity (e.g., nuclease activity, nickase activity, recombinase activity, deaminase activity, transcriptional activation, transcriptional repression, epigenetic modification activity, gRNA binding activity, and/or target nucleic acid binding activity) as compared to either the wild type counterpart of the protein or the intein-excised form of the protein. In some embodiments, following excision of the intein, the protein exhibits at least a 1.25-fold increase, at least a 1.5-fold increase, at least 1.75-fold increase, at least a 2.0-fold increase, at least a 2.25-fold increase, at least a 2.5-fold increase, at least a 2.75-fold increase, at least a 3.0-fold increase, at least a 3.25-fold increase, at least a 3.5-fold increase, at least a 3.75-fold increase, at least a 4.0-fold increase, at least a 4.5-fold increase, at least a 5.0-fold increase, at least a 5.5-fold increase, at least a 6.0-fold increase, at least a 6.5-fold increase, at least a 7.0-fold increase, at least a 7.5-fold increase, at least a 8.0-fold increase, at least a 8.5-fold increase, at least a 9.0-fold increase, at least a 9.5-fold increase, or at least a 10.0-fold or more increase in activity (e.g., nuclease activity, nickase activity, recombinase activity, or deaminase activity) as compared to the intein-intact form of the protein. Methods for assessing the activity of any ligand-dependent site-specific Cas9-containing enzyme provided herein are well known to those of ordinary skill in the art, and in the context of nuclease activity include those described in the Examples.

In some embodiments, upon excision, the intein leaves a cysteine residue. Thus, if the intein is inserted such that it replaces a cysteine, the Cas9 protein, upon intein excision, will be unmodified as compared to the original protein. If the intein replaces any other amino acid, the Cas9 protein, upon intein excision, will contain a cysteine in place of the amino acid that was replaced. In some embodiments, the intein does not replace an amino acid residue in a Cas9 protein, but is inserted into the Cas9 protein (e.g., in addition to the amino acid residues of the Cas9 protein). In this aspect, upon excision, the protein will comprise an additional cysteine residue. While the presence of an additional cysteine residue (or the substitution of a residue for a cysteine upon excision) is unlikely to affect the function of the Cas9 protein, in some embodiments where the intein does not replace a cysteine, the intein replaces an alanine, serine, or threonine amino acid, as these residues are similar in size and/or polarity to cysteine.

Accordingly, in some embodiments, the intein is inserted into one or both of the nuclease domains of Cas9 or a Cas9 variant (e.g., dCas9, Cas9 nickase), such as the HNH domain and/or the RuvC domain. In some embodiments, the intein is inserted into one or more other domains of Cas9 or a Cas9 variant (e.g., dCas9, Cas9 nickase), such as, REC1, REC2, PAM-interacting (PI), and/or bridge helix (BH) domain. The sequences and structure corresponding to these domains are known, and in some aspects are represented by the underlined segments of SEQ ID NO:2 (Cas9) and SEQ ID NO:5 (dCas9) above (See also, Nishimasu et al., "Crystal structure of Cas9 in complex with guide RNA and target DNA." Cell. 2014; 156(5), 935-949). In some embodiments, the intein is inserted into any location of Cas9, e.g., any location that disrupts one or more activities of Cas9 (e.g., enzymatic activity, gRNA binding activity, and/or DNA binding activity). In some embodiments, the intein is inserted into a sequence of Cas9 or a Cas9 variant such that the intein sequence replaces one or more amino acids in the protein. In some embodiments, the intein replaces any cysteine, any alanine, any threonine, or any serine residue in Cas9 or a Cas9 variant including Cas9 nickase and dCas9 (and fusions thereof). In some embodiments the inserted intein sequence replaces Cys80, Ala127, Thr146, Ser219, Thr333, Thr519, Cys574, Thr622, Ser701, Ala728, Thr995, Ser1006, Ser1154, Ser1159, or Ser1274 in Cas9 (SEQ ID NO:2), dCas9 (SEQ ID NO:5), or Cas9 nickase (SEQ ID NO:4). In some embodiments, the intein is inserted within 5, within 10, within 15, or within 20 amino acids of Cys80, Ala127, Thr146, Ser219, Thr333, Thr519, Cys574, Thr622, Ser701, Ala728, Thr995, Ser1006, Ser1154, Ser1159, or Ser1274 in Cas9 (SEQ ID NO:2), dCas9 (SEQ ID NO:5), or Cas9 nickase (SEQ ID NO:4). In some embodiments, the inserted intein sequence replaces Ala127, Thr146, Ser219, Thr519, or Cys574 in Cas9 (SEQ ID NO:2), dCas9 (SEQ ID NO:5), or Cas9 nickase (SEQ ID NO:4). In some embodiments, a Cas9 protein comprising an intein comprises an amino acid sequence selected from the group consisting of SEQ ID NOs:27-41, or comprises an amino acid sequence that has at least 80%, at least 85%, at least 90%, at least 95%, or at least 99% sequence identity to any one of SEQ ID NOs:27-41. In some embodiments, the intein is inserted into the protein such that it does not replace any amino acid, but is added in addition to the amino acids of the protein. The intein that is inserted into the protein can be any ligand-dependent intein, e.g., those described herein. For example, in some embodiments, the intein that is inserted into the protein comprises, in part or in whole, a sequence that is at least 80%, at least 85%, at least 90%, at least 95%, at least 99%, or 100% identical to any one of SEQ ID NO:27-41.

```
Cas9:Intein (37R3-2; in double underline) replacing Cys80
                                                        (SEQ ID NO: 27)
MDKKYSIGLDIGTNSVGWAVITDEYKVPSKKFKVLGNTDRHSIKKNLIGALLFDSGETAEATRLKRTA

RRRYTRRKNRICLAEGTRIFDPVTGTTHRIEDVVDGRKPIHVVAAAKDGTLLARPVVSWFDQGTRDVI

GLRIAGGAIVWATPDHKVLTEYGWRAAGELRKGDRVAGPGGSGNSLALSLTADQMVSALLDAEPPILY

SEYDPTSPFSEASMMGLLTNLADRELVHMINWAKRVPGFVDLTLHDQAHLLERAWLEILMIGLVWRSM

EHPGKLLFAPNLLLDRNQGKCVEGMVEIFDMLLATSSRFRMMNLQGEEFVCLKSIILLNSGVYTFLSS

TLKSLEEKDHIHRALDKITDTLIHLMAKAGLTLQQQHQRLAQLLLILSHIRHMSNKGMEHLYSMKYKN

VVPLYDLLLEMLDAHRLHAGGSGASRVQAFADALDDKFLHDMLAEGLRYSVIREVLPTRRARTFDLEV

EELHTLVAEGVVVHNCYLQEIFSNEMAKVDDSFFHRLEESFLVEEDKKHERHPIFGNIVDEVAYHEKY

PTIYHLRKKLVDSTDKADLRLIYLALAHMIKFRGHFLIEGDLNPDNSDVDKLFIQLVQTYNQLFEENP
```

-continued

INASGVDAKAILSARLSKSRRLENLIAQLPGEKKNGLFGNLIALSLGLTPNFKSNFDLAEDAKLQLSK

DTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ala127

(SEQ ID NO: 28)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEV<u>CLAEGTRIFD</u>

<u>PVTGTTHRIEDVVDGRKPIHVVAAAKDGTLLARPVVSWFDQGTRDVIGLRIAGGAIVWATPDHKVLTE</u>

<u>YGWRAAGELRKGDRVAGPGGSGNSLALSLTADQMVSALLDAEPPILYSEYDPTSPFSEASMMGLLTNL</u>

<u>ADRELVHMINWAKRVPGFVDLTLHDQAHLLERAWLEILMIGLVWRSMEHPGKLLFAPNLLLDRNQGKC</u>

<u>VEGMVEIFDMLLATSSRFRMMNLQGEEFVCLKSIILLNSGVYTFLSSTLKSLEEKDHIHRALDKITDT</u>

<u>LIHLMAKAGLTLQQQHQRLAQLLLILSHIRHMSNKGMEHLYSMKYKNVVPLYDLLLEMLDAHRLHAGG</u>

<u>SGASRVQAFADALDDKFLHDMLAEGLRYSVIREVLPTRRARTFDLEVEELHTLVAEGVVVHNC</u>YHEKY

PTIYHLRKKLVDSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDLAEDAKLQLSK

DTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

```
DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Thr146
                                                          (SEQ ID NO: 29)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSCLAEGTRIFDPVTGTTHRIEDVVDGRKPIHVVAAAKDGTLLARPVVSWFDQGTRDVIGL

RIAGGAIVWATPDHKVLTEYGWRAAGELRKGDRVAGPGGSGNSLALSLTADQMVSALLDAEPPILYSE

YDPTSPFSEASMMGLLTNLADRELVHMINWAKRVPGFVDLTLHDQAHLLERAWLEILMIGLVWRSMEH

PGKLLFAPNLLLDRNQGKCVEGMVEIFDMLLATSSRFRMMNLQGEEFVCLKSIILLNSGVYTFLSSTL

KSLEEKDHIHRALDKITDTLIHLMAKAGLTLQQQHQRLAQLLLILSHIRHMSNKGMEHLYSMKYKNVV

PLYDLLLEMLDAHRLHAGGSGASRVQAFADALDDKFLHDMLAEGLRYSVIREVLPTRRARTFDLEVEE

LHTLVAEGVVVHNCDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDLAEDAKLQLSK

DTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser219
                                                          (SEQ ID NO: 30)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKCLAEGTRIFDPVTGTTHRIEDVVDGRKPIHVVAAAKDGTLLARPVVSWFDQGTR

DVIGLRIAGGAIVWATPDHKVLTEYGWRAAGELRKGDRVAGPGGSGNSLALSLTADQMVSALLDAEPP

ILYSEYDPTSPFSEASMMGLLTNLADRELVHMINWAKRVPGFVDLTLHDQAHLLERAWLEILMIGLVW
```

-continued

<u>RSMEHPGKLLFAPNLLLDRNQGKCVEGMVEIFDMLLATSSRFRMMNLQGEEFVCLKSIILLNSGVYTF</u>
<u>LSSTLKSLEEKDHIHRALDKITDTLIHLMAKAGLTLQQQHQRLAQLLLILSHIRHMSNKGMEHLYSMK</u>
<u>YKNVVPLYDLLLEMLDAHRLHAGGSGASRVQAFADALDDKFLHDMLAEGLRYSVIREVLPTRRARTFD</u>
<u>LEVEELHTLVAEGVVVHNC</u>RRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLSASMIKRYDEHHQDLTLLK
ALVRQQLPEKYKEIFFDQSKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSG
KTILDFLKSDGFANRNFMQLIHDDSLTFKEDIQKAQVSGQGDSLHEHIANLAGSPAIKKGILQTVKVV
DELVKVMGRHKPENIVIEMARENQTTQKGQKNSRERMKRIEEGIKELGSQILKEHPVENTQLQNEKLY
LYYLQNGRDMYVDQELDINRLSDYDVDHIVPQSFLKDDSIDNKVLTRSDKNRGKSDNVPSEEVVKKMK
NYWRQLLNAKLITQRKFDNLTKAERGGLSELDKAGFIKRQLVETRQITKHVAQILDSRMNTKYDENDK
LIREVKVITLKSKLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWDKGRDFATVR
KVLSMPQVNIVKKTEVQTGGFSKESILPKRNSDKLIARKKDWDPKKYGGFDSPTVAYSVLVVAKVEKG
KSKKLKSVKELLGITIMERSSFEKNPIDFLEAKGYKEVKKDLIIKLPKYSLFELENGRKRMLASAGEL
QKGNELALPSKYVNFLYLASHYEKLKGSPEDNEQKQLFVEQHKHYLDEIIEQISEFSKRVILADANLD
KVLSAYNKHRDKPIREQAENIIHLFTLTNLGAPAAFKYFDTTIDRKRYTSTKEVLDATLIHQSITGLY
ETRIDLSQLGGD

Cas9:Intein (37R3-2; in double underline) replacing Thr333
(SEQ ID NO: 31)
MDKKYSIGLDIGTNSVGWAVITDEYKVPSKKFKVLGNTDRHSIKKNLIGALLFDSGETAEATRLKRTA
RRRYTRRKNRICYLQEIFSNEMAKVDDSFFHRLEESFLVEEDKKHERHPIFGNIVDEVAYHEKYPTIY
HLRKKLVDSTDKADLRLIYLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKSNFDLAEDAKLQLSKDTYD
DDLDNLLAQIGDQYADLFLAAKNLSDAILLSDILRVNTEITKAPLSASMIKRYDEHHQDL<u>CLAEGTRI</u>
<u>FDPVTGTTHRIEDVVDGRKPIHVVAAAKDGTLLARPVVSWFDQGTRDVIGLRIAGGAIVWATPDHKVL</u>
<u>TEYGWRAAGELRKGDRVAGPGGSGNSLALSLTADQMVSALLDAEPPILYSEYDPTSPFSEASMMGLLT</u>
<u>NLADRELVHMINWAKRVPGFVDLTLHDQAHLLERAWLEILMIGLVWRSMEHPGKLLFAPNLLLDRNQG</u>
<u>KCVEGMVEIFDMLLATSSRFRMMNLQGEEFVCLKSIILLNSGVYTFLSSTLKSLEEKDHIHRALDKIT</u>
<u>DTLIHLMAKAGLTLQQQHQRLAQLLLILSHIRHMSNKGMEHLYSMKYKNVVPLYDLLLEMLDAHRLHA</u>
<u>GGSGASRVQAFADALDDKFLHDMLAEGLRYSVIREVLPTRRARTFDLEVEELHTLVAEGVVVHNC</u>LLK
ALVRQQLPEKYKEIFFDQSKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSG
KTILDFLKSDGFANRNFMQLIHDDSLTFKEDIQKAQVSGQGDSLHEHIANLAGSPAIKKGILQTVKVV
DELVKVMGRHKPENIVIEMARENQTTQKGQKNSRERMKRIEEGIKELGSQILKEHPVENTQLQNEKLY -continued

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Thr519
(SEQ ID NO: 32)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFCLAEGTRIFDPVTGTTHRIEDVVDGR

KPIHVVAAAKDGTLLARPVVSWFDQGTRDVIGLRIAGGAIVWATPDHKVLTEYGWRAAGELRKGDRVA

GPGGSGNSLALSLTADQMVSALLDAEPPILYSEYDPTSPFSEASMMGLLTNLADRELVHMINWAKRVP

GFVDLTLHDQAHLLERAWLEILMIGLVWRSMEHPGKLLFAPNLLLDRNQGKCVEGMVEIFDMLLATSS

RFRMMNLQGEEFVCLKSIILLNSGVYTFLSSTLKSLEEKDHIHRALDKITDTLIHLMAKAGLTLQQQH

QRLAQLLLILSHIRHMSNKGMEHLYSMKYKNVVPLYDLLLEMLDAHRLHAGGSGASRVQAFADALDDK

FLHDMLAEGLRYSVIREVLPTRRARTFDLEVEELHTLVAEGVVVHNCVYNELTKVKYVTEGMRKPAFL

SGEQKKAIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Cys574
(SEQ ID NO: 33)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

-continued

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIE<u>CLAEGTRIFDPVTGTTHRIEDVVDGRKPIHVVAAAKDGT</u>

<u>LLARPVVSWFDQGTRDVIGLRIAGGAIVWATPDHKVLTEYGWRAAGELRKGDRVAGPGGSGNSLALSL</u>

<u>TADQMVSALLDAEPPILYSEYDPTSPFSEASMMGLLTNLADRELVHMINWAKRVPGFVDLTLHDQAHL</u>

<u>LERAWLEILMIGLVWRSMEHPGKLLFAPNLLLDRNQGKCVEGMVEIFDMLLATSSRFRMMNLQGEEFV</u>

<u>CLKSIILLNSGVYTFLSSTLKSLEEKDHIHRALDKITDTLIHLMAKAGLTLQQQHQRLAQLLLILSHI</u>

<u>RHMSNKGMEHLYSMKYKNVVPLYDLLLEMLDAHRLHAGGSGASRVQAFADALDDKFLHDMLAEGLRYS</u>

<u>VIREVLPTRRARTFDLEVEELHTLVAEGVVVHNC</u>FDSVEISGVEDRFNASLGTYHDLLKIIKDKDFLD

NEENEDILEDIVLTLTLFEDREMIEERLKTYAHLFDDKVMQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Thr622
(SEQ ID NO: 34)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVL<u>CLAEGTRIFDPVTGTTHRIEDVVDGRKPIHVVAAAKDGTLLARPVVSWFDQGTRDVIGL</u>

<u>RIAGGAIVWATPDHKVLTEYGWRAAGELRKGDRVAGPGGSGNSLALSLTADQMVSALLDAEPPILYSE</u>

<u>YDPTSPFSEASMMGLLTNLADRELVHMINWAKRVPGFVDLTLHDQAHLLERAWLEILMIGLVWRSMEH</u>

<u>PGKLLFAPNLLLDRNQGKCVEGMVEIFDMLLATSSRFRMMNLQGEEFVCLKSIILLNSGVYTFLSSTL</u>

<u>KSLEEKDHIHRALDKITDTLIHLMAKAGLTLQQQHQRLAQLLLILSHIRHMSNKGMEHLYSMKYKNVV</u>

<u>PLYDLLLEMLDAHRLHAGGSGASRVQAFADALDDKFLHDMLAEGLRYSVIREVLPTRRARTFDLEVEE</u>

-continued

LHTLVAEGVVVHNCLTLFEDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser701
(SEQ ID NO: 35)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDCLAEGTRIFDPVTGTTHRIEDVVDGRKPIHVVAAAKDGTLLARPVVSW

FDQGTRDVIGLRIAGGAIVWATPDHKVLTEYGWRAAGELRKGDRVAGPGGSGNSLALSLTADQMVSAL

LDAEPPILYSEYDPTSPFSEASMMGLLTNLADRELVHMINWAKRVPGFVDLTLHDQAHLLERAWLEIL

MIGLVWRSMEHPGKLLFAPNLLLDRNQGKCVEGMVEIFDMLLATSSRFRMMNLQGEEFVCLKSIILLN

SGVYTFLSSTLKSLEEKDHIHRALDKITDTLIHLMAKAGLTLQQQHQRLAQLLLILSHIRHMSNKGME

HLYSMKYKNVVPLYDLLLEMLDAHRLHAGGSGASRVQAFADALDDKFLHDMLAEGLRYSVIREVLPTR

RARTFDLEVEELHTLVAEGVVVHNCLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

-continued

Cas9:Intein (37R3-2; in double underline) replacing Ala728
(SEQ ID NO: 36)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANL<u>CLAEGTRIFDPVTGTTHRIED</u>

<u>VVDGRKPIHVVAAAKDGTLLARPVVSWFDQGTRDVIGLRIAGGAIVWATPDHKVLTEYGWRAAGELRK</u>

<u>GDRVAGPGGSGNSLALSLTADQMVSALLDAEPPILYSEYDPTSPFSEASMMGLLTNLADRELVHMINW</u>

<u>AKRVPGFVDLTLHDQAHLLERAWLEILMIGLVWRSMEHPGKLLFAPNLLLDRNQGKCVEGMVEIFDML</u>

<u>LATSSRFRMMNLQGEEFVCLKSIILLNSGVYTFLSSTLKSLEEKDHIHRALDKITDTLIHLMAKAGLT</u>

<u>LQQQHQRLAQLLLILSHIRHMSNKGMEHLYSMKYKNVVPLYDLLLEMLDAHRLHAGGSGASRVQAFAD</u>

<u>ALDDKFLHDMLAEGLRYSVIREVLPTRRARTFDLEVEELHTLVAEGVVVHN</u>CGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Thr995
(SEQ ID NO: 37)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVVDELV

-continued

KVMGRHKPENIVIEMARENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDKLIRE

VKVITLKSKLVSDFRKDFQFYKVREINNYHHAHDAYLNAVVG<u>CLAEGTRIFDPVTGTTHRIEDVVDGR</u>

<u>KPIHVVAAAKDGTLLARPVVSWFDQGTRDVIGLRIAGGAIVWATPDHKVLTEYGWRAAGELRKGDRVA</u>

<u>GPGGSGNSLALSLTADQMVSALLDAEPPILYSEYDPTSPFSEASMMGLLTNLADRELVHMINWAKRVP</u>

<u>GFVDLTLHDQAHLLERAWLEILMIGLVWRSMEHPGKLLFAPNLLLDRNQGKCVEGMVEIFDMLLATSS</u>

<u>RFRMMNLQGEEFVCLKSIILLNSGVYTFLSSTLKSLEEKDHIHRALDKITDTLIHLMAKAGLTLQQQH</u>

<u>QRLAQLLLILSHIRHMSNKGMEHLYSMKYKNVVPLYDLLLEMLDAHRLHAGGSGASRVQAFADALDDK</u>

<u>FLHDMLAEGLRYSVIREVLPTRRARTFDLEVEELHTLVAEGVVVHNC</u>ALIKKYPKLESEFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser1006
(SEQ ID NO: 38)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDKLIRE

VKVITLKSKLVSDFRKDFQFYKVREINNYHHAHDAYLNAVVGTALIKKYPKLE<u>CLAEGTRIFDPVTGT</u>

<u>THRIEDVVDGRKPIHVVAAAKDGTLLARPVVSWFDQGTRDVIGLRIAGGAIVWATPDHKVLTEYGWRA</u>

<u>AGELRKGDRVAGPGGSGNSLALSLTADQMVSALLDAEPPILYSEYDPTSPFSEASMMGLLTNLADREL</u>

<u>VHMINWAKRVPGFVDLTLHDQAHLLERAWLEILMIGLVWRSMEHPGKLLFAPNLLLDRNQGKCVEGMV</u>

<u>EIFDMLLATSSRFRMMNLQGEEFVCLKSIILLNSGVYTFLSSTLKSLEEKDHIHRALDKITDTLIHLM</u>

<u>AKAGLTLQQQHQRLAQLLLILSHIRHMSNKGMEHLYSMKYKNVVPLYDLLLEMLDAHRLHAGGSGASR</u>

<u>VQAFADALDDKFLHDMLAEGLRYSVIREVLPTRRARTFDLEVEELHTLVAEGVVVHNC</u>EFVYGDYKVY

DVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLASAGEL

-continued

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser1154
(SEQ ID NO: 39)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDKLIRE

VKVITLKSKLVSDFRKDFQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKGK<u>CLA</u>

<u>EGTRIFDPVTGTTHRIEDVVDGRKPIHVVAAAKDGTLLARPVVSWFDQGTRDVIGLRIAGGAIVWATP</u>

<u>DHKVLTEYGWRAAGELRKGDRVAGPGGSGNSLALSLTADQMVSALLDAEPPILYSEYDPTSPFSEASM</u>

<u>MGLLTNLADRELVHMINWAKRVPGFVDLTLHDQAHLLERAWLEILMIGLVWRSMEHPGKLLFAPNLLL</u>

<u>DRNQGKCVEGMVEIFDMLLATSSRFRMMNLQGEEFVCLKSIILLNSGVYTFLSSTLKSLEEKDHIHRA</u>

<u>LDKITDTLIHLMAKAGLTLQQQHQRLAQLLLILSHIRHMSNKGMEHLYSMKYKNVVPLYDLLLEMLDA</u>

<u>HRLHAGGSGASRVQAFADALDDKFLHDMLAEGLRYSVIREVLPTRRARTFDLEVEELHTLVAEGVVVH</u>

<u>NC</u>KKLKSVKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser1159
(SEQ ID NO: 40)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDKLIRE

VKVITLKSKLVSDFRKDFQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKGKSKK

LK<u>CLAEGTRIFDPVTGTTHRIEDVVDGRKPIHVVAAAKDGTLLARPVVSWFDQGTRDVIGLRIAGGAI</u>

<u>VWATPDHKVLTEYGWRAAGELRKGDRVAGPGGSGNSLALSLTADQMVSALLDAEPPILYSEYDPTSPF</u>

<u>SEASMMGLLTNLADRELVHMINWAKRVPGFVDLTLHDQAHLLERAWLEILMIGLVWRSMEHPGKLLFA</u>

<u>PNLLLDRNQGKCVEGMVEIFDMLLATSSRFRMMNLQGEEFVCLKSIILLNSGVYTFLSSTLKSLEEKD</u>

<u>HIHRALDKITDTLIHLMAKAGLTLQQQHQRLAQLLLILSHIRHMSNKGMEHLYSMKYKNVVPLYDLLL</u>

<u>EMLDAHRLHAGGSGASRVQAFADALDDKFLHDMLAEGLRYSVIREVLPTRRARTFDLEVEELHTLVAE</u>

<u>GVVVHNC</u>VKELLGITIMERSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

Cas9:Intein (37R3-2; in double underline) replacing Ser1274
(SEQ ID NO: 41)
MDKKYSIGLDIGTNSVGWAVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPIFGNIVDEVAYHEKYPTIY

HLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYD

DDLDNLLAQIGDQYADLFLAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDKLIRE

VKVITLKSKLVSDFRKDFQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQI<u>CLAEGTRIFDPVTGTTHRI</u>

<u>EDVVDGRKPIHVVAAAKDGTLLARPVVSWFDQGTRDVIGLRIAGGAIVWATPDHKVLTEYGWRAAGEL</u>

<u>RKGDRVAGPGGSGNSLALSLTADQMVSALLDAEPPILYSEYDPTSPFSEASMMGLLTNLADRELVHMI</u>

-continued

NWAKRVPGFVDLTLHDQAHLLERAWLEILMIGLVWRSMEHPGKLLFAPNLLLDRNQGKCVEGMVEIFD

MLLATSSRFRMMNLQGEEFVCLKSIILLNSGVYTFLSSTLKSLEEKDHIHRALDKITDTLIHLMAKAG

LTLQQQHQRLAQLLLILSHIRHMSNKGMEHLYSMKYKNVVPLYDLLLEMLDAHRLHAGGSGASRVQAF

ADALDDKFLHDMLAEGLRYSVIREVLPTRRARTFDLEVEELHTLVAEGVVVHNCEFSKRVILADANLD

KVLSAYNKHRDKPIREQAENIIHLFTLTNLGAPAAFKYFDTTIDRKRYTSTKEVLDATLIHQSITGLY

ETRIDLSQLGGD

In some embodiments, the intein inserted into the Cas9 protein is ligand-dependent. In some embodiments, the ligand-dependent inteins comprise a modified ligand-binding domain of the estrogen receptor protein, embedded into a modified RecA intein from *M. tuberculosis*. In some embodiments, the ligand-binding domain is derived from an estrogen receptor protein, for example, from the human estrogen receptor. The sequence of the human estrogen receptor and the location of the ligand-binding domain within the human estrogen receptor are known to those of skill in the art. Non-limiting, exemplary sequences of the human estrogen receptor can be retrieved from RefSeq database entries NP_000116 (isoform 1); NP_001116212 (isoform 2); NP_001116213 (isoform 3); and NP_001116214 (isoform 4) from the National Center for Biotechnology Information (NCBI, www.ncbi.nlm.nih.gov). In some embodiments, the ligand-binding domain of a ligand-dependent intein provided herein comprises or is derived from a sequence comprising amino acid residues 304-551 of the human estrogen receptor.

It will be appreciated by those of skill in the art that other ligand-dependent inteins are also suitable and useful in connection with the Cas9 proteins and methods provided herein. For example, some aspects of this invention provide Cas9 proteins comprising ligand-dependent inteins that comprise a ligand-binding domain of a hormone-binding protein, e.g., of an androgen receptor, an estrogen receptor, an ecdysone receptor, a glucocorticoid receptor, a mineralocorticoid receptor, a progesterone receptor, a retinoic acid receptor, or a thyroid hormone receptor protein. Ligand-binding domains of hormone-binding receptors, inducible fusion proteins comprising such ligand-binding domains, and methods for the generation of such fusion proteins are known to those of skill in the art (see, e.g., Becker, D., Hollenberg, S., and Ricciardi, R. (1989). Fusion of adenovirus E1A to the glucocorticoid receptor by high-resolution deletion cloning creates a hormonally inducible viral transactivator. Mol. Cell. Biol. 9, 3878-3887; Boehmelt, G., Walker, A., Kabrun, N., Mellitzer, G., Beug, H., Zenke, M., and Enrietto, P. J. (1992). Hormone-regulated v-rel estrogen receptor fusion protein: reversible induction of cell transformation and cellular gene expression. EMBO J 11, 4641-4652; Braselmann, S., Graninger, P., and Busslinger, M. (1993). A selective transcriptional induction system for mammalian cells based on Gal4-estrogen receptor fusion proteins. Proc Natl Acad Sci USA 90, 1657-1661; Furga G, Busslinger M (1992). Identification of Fos target genes by the use of selective induction systems. J. Cell Sci. Suppl 16, 97-109; Christopherson, K. S., Mark, M. R., Bajaj, V., and Godowski, P. J. (1992). Ecdysteroid-dependent regulation of genes in mammalian cells by a *Drosophila* ecdysone receptor and chimeric transactivators. Proc Natl Acad Sci USA 89, 6314-8; Eilers, M., Picard, D., Yamamoto, K., and Bishop, J. (1989). Chimaeras of Myc oncoprotein and steriod receptors cause hormone-dependent transformation of cells. Nature 340, 66-68; Fankhauser, C. P., Briand, P. A., and Picard, D. (1994). The hormone binding domain of the mineralocorticoid receptor can regulate heterologous activities in cis. Biochem Biophys Res Commun 200, 195-201; Godowski, P. J., Picard, D., and Yamamoto, K. R. (1988). Signal transduction and transcriptional regulation by glucocorticoid receptor-LexA fusion proteins. Science 241, 812-816; Kellendonk, C., Tronche, F., Monaghan, A., Angrand, P., Stewart, F., and Schütz, G. (1996). Regulation of Cre recombinase activity by the synthetic steroid RU486. Nuc. Acids Res. 24, 1404-1411; Lee, J. W., Moore, D. D., and Heyman, R. A. (1994). A chimeric thyroid hormone receptor constitutively bound to DNA requires retinoid X receptor for hormone-dependent transcriptional activation in yeast. Mol Endocrinol 8, 1245-1252; No, D., Yao, T. P., and Evans, R. M. (1996). Ecdysone-inducible gene expression in mammalian cells and transgenic mice. Proc Natl Acad Sci USA 93, 3346-3351; and Smith, D., Mason, C., Jones, E., and Old, R. (1994). Expression of a dominant negative retinoic acid receptor g in *Xenopus* embryos leads to partial resistance to retinoic acid. Roux's Arch. Dev. Biol. 203, 254-265; all of which are incorporated herein by reference in their entirety). Additional ligand-binding domains useful for the generation of ligand-dependent inteins as provided herein will be apparent to those of skill in the art, and the invention is not limited in this respect.

Additional exemplary inteins, ligand-binding domains, and ligands suitable for use in the Cas9 proteins provided herein are described in International Patent Application, PCT/US2012/028435, entitled "Small Molecule-Dependent Inteins and Uses Thereof," filed Mar. 9, 2012, and published as WO 2012/125445 on Sep. 20, 2012, the entire contents of which are incorporated herein by reference. Additional suitable inteins, ligand-binding domains, and ligands will be apparent to the skilled artisan based on this disclosure.

The ligand-dependent inteins provided herein are inactive (or only minimally active) in the absence of the appropriate ligand, but can be induced to be active, and, thus, to self-excise, by contacting them with a ligand that binds the ligand-binding domain of the human estrogen receptor. Small molecule ligands binding the ligand-binding domain of the estrogen receptor (e.g., the human estrogen receptor), and thus useful to induce the activity of the ligand-dependent inteins described herein, are known to those of skill in the art. In some embodiments, the ligand used to induce the activity of the ligand-dependent inteins described herein specifically binds to the ligand-binding domain of the estrogen receptor. In some embodiments, the ligand binds the ligand-binding domain of a ligand-dependent intein provided herein with high affinity, for example, with an affinity of at least about $10^{-10}$ M, at least about $10^{-9}$ M, at least about $10^{-8}$ M, at least about $10^{-7}$ M, at least about $10^{-6}$ M, or at least at out $10^{-6}$ M. Examples of appropriate estrogen receptor-binding ligands that are useful to induce the activity of the ligand-dependent inteins provided herein, for example, the ligand-dependent inteins provided in SEQ ID NOs 3-8, include, but are not limited to, 17β-estradiol, 17α-ethynyl estradiol, tamoxifen and tamoxifen analogs (e.g., 4-hydroxytamoxifen (4-HT, 4-OHT), 3-hydroxytamoxifen (droloxifene)), tamoxifen metabolites (e.g., hydroxytamoxifen, endoxifen), raloxifene, toremifene, ICI-182, and ICI-780. Other useful ligands will be apparent to those of skill in the art, and the invention is not limited in this respect.

In some embodiments, any of the Cas9 proteins comprising inteins (e.g., SEQ ID NOs:27-41) can be modified so as to generate a Cas9 nickase comprising an intein (e.g., by making one of a D10A or H840A mutation relative to the Cas9 sequence lacking an intein), or to generate a dCas9 protein comprising an intein (e.g., by making both D10A and H840A mutations relative to the Cas9 sequence lacking an intein). In some embodiments, any of the Cas9 proteins comprising inteins (e.g., SEQ ID NOs:27-41) have additional features, for example, one or more linker sequences, localization sequences, such as nuclear localization sequences (NLS; e.g., MAPKKKRKVGIHRGVP (SEQ ID NO:42)); cytoplasmic localization sequences; export sequences, such as nuclear export sequences; or other localization sequences, as well as sequence tags that are useful for solubilization, purification, or detection of the fusion proteins. Suitable localization signal sequences and sequences of protein tags are provided herein and are known in the art, and include, but are not limited to, biotin carboxylase carrier protein (BCCP) tags, myc-tags, calmodulin-tags, FLAG-tags (e.g., 3×FLAG TAG: MDYKDHDGDYKDHDIDYKDDDDK (SEQ ID NO:43)), hemagglutinin (HA) tags, polyhistidine tags, also referred to as histidine tags or His-tags, maltose binding protein (MBP)-tags, nus-tags, glutathione-S-transferase (GST) tags, green fluorescent protein (GFP) tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art.

In some embodiments, ligand-dependent site-specific enzymes (e.g., fusion proteins) are provided which comprise a Cas9 variant (e.g., dCas9), a ligand-dependent intein, and one or more other polypeptide domains having a particular enzymatic activity. In some embodiments, the fusion protein comprises a nuclease inactivated Cas9 domain (e.g., dCas9), wherein the dCas9 domain comprises an intein sequence inserted in place of or in addition to any amino acid in dCas9. In some embodiments the inserted intein sequence replaces Cys80, Ala127, Thr146, Ser219, Thr333, Thr519, Cys574, Thr622, Ser701, Ala728, Thr995, Ser1006, Ser1154, Ser1159, or Ser1274 of dCas9 (SEQ ID NO:5). In some embodiments, the inserted intein sequence replaces Ala127, Thr146, Ser219, Thr519, or Cys574 of dCas9 (SEQ ID NO:5). In some embodiments, the intein is inserted into another domain of the fusion protein (i.e., not in the Cas9 domain, e.g., not in the dCas9 domain), such as the domain having a particular enzymatic activity. In some embodiments, the domain having a particular enzymatic activity is a nuclease domain (e.g., FokI), a recombinase catalytic domain (e.g., Hin, Gin, or Tn3 recombinase domains), a nucleic acid-editing domain (e.g., a deaminase domain), a transcriptional activator domain (e.g., VP64, p65), a transcriptional repressor domain (e.g., KRAB, SID), or an epigenetic modifier (e.g., LSD1 histone demethylase, TET1 hydroxylase). The intein that is inserted into the fusion protein can be any ligand-dependent intein, e.g., those described herein. For example, in some embodiments, the intein that is inserted into a Cas9 protein comprises in part or in whole, a sequence that is at least 80%, at least 85%, at least 90%, at least 95%, at least 99%, or 100% percent identical to any one of SEQ ID NO:7-14.

In some embodiments, the general architecture of exemplary fusion proteins provided herein comprises the structure:

[NH$_2$]-[enzymatic domain]-[dCas9]-[COOH] or
[NH$_2$]-[dCas9]-[enzymatic domain]-[COOH];

wherein NH$_2$ is the N-terminus of the fusion protein, COOH is the C-terminus of the fusion protein, dCas9 comprises an intein as provided herein, and the enzymatic domain comprises a nuclease domain (e.g., FokI), a recombinase catalytic domain (e.g., Hin, Gin, or Tn3 recombinase domains), a nucleic acid-editing domain (e.g., a deaminase domain), a transcriptional activator domain (e.g., VP64, p65), a transcriptional repressor domain (e.g., KRAB, SID), or an epigenetic modifier (e.g., LSD1 histone demethylase, TET1 hydroxylase). In some embodiments, the intein is comprised in a domain other than dCas9 (e.g., in an enzymatic domain), or is located between two domains.

Additional features may be present, for example, one or more linker sequences between certain domains. Other exemplary features that may be present are localization sequences, such as nuclear localization sequences (NLS; e.g., MAPKKKRKVGIHRGVP (SEQ ID NO:42)); cytoplasmic localization sequences; export sequences, such as nuclear export sequences; or other localization sequences, as well as sequence tags that are useful for solubilization, purification, or detection of the fusion proteins. Suitable localization signal sequences and sequences of protein tags are provided herein and are known in the art, and include, but are not limited to, biotin carboxylase carrier protein (BCCP) tags, myc-tags, calmodulin-tags, FLAG-tags (e.g., 3×FLAG TAG: MDYKDHDGDYKDHDIDYKDDDDK (SEQ ID NO:43)), hemagglutinin (HA) tags, polyhistidine tags, also referred to as histidine tags or His-tags, maltose binding protein (MBP)-tags, nus-tags, glutathione-S-transferase (GST) tags, green fluorescent protein (GFP) tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art.

In some embodiments, the enzymatic domain comprises a nuclease or a catalytic domain thereof. For example, in some embodiments, the general architecture of exemplary ligand-dependent dCas9 fusion proteins with a nuclease domain comprises the structure:

[NH$_2$]-[NLS]-[dCas9]-[nuclease]-[COOH],
[NH$_2$]-[NLS]-[nuclease]-[dCas9]-[COOH],
[NH$_2$]-[dCas9]-[nuclease]-[COOH], or
[NH$_2$]-[nuclease]-[dCas9HCOOH];

wherein NLS is a nuclear localization signal, dCas9 comprises an intein as provided herein, NH$_2$ is the N-terminus of the fusion protein, and COOH is the C-terminus of the fusion protein. In some embodiments, a linker is inserted between the dCas9 and the nuclease domain. In some embodiments, a linker is inserted between the NLS and the nuclease and/or dCas9 domain. In some embodiments, the NLS is located C-terminal of the nuclease and/or the dCas9 domain. In some embodiments, the NLS is located between the nuclease and the dCas9 domain. Additional features, such as sequence tags, may also be present. In some aspects, the nuclease domain is a nuclease requiring dimerization (e.g., the coming together of two monomers of the nuclease)

in order to cleave a target nucleic acid (e.g., DNA). In some embodiments, the nuclease domain is a monomer of the FokI DNA cleavage domain. The FokI DNA cleavage domain is known, and in some aspects corresponds to amino acids 388-583 of FokI (NCBI accession number J04623). In some embodiments, the FokI DNA cleavage domain corresponds to amino acids 300-583, 320-583, 340-583, or 360-583 of FokI. See also Wah et al., "Structure of FokI has implications for DNA cleavage" *Proc. Natl. Acad. Sci. USA.* 1998; 1; 95(18):10564-9; Li et al., "TAL nucleases (TALNs): hybrid proteins composed of TAL effectors and FokI DNA-cleavage domain" *Nucleic Acids Res.* 2011; 39(1):359-72; Kim et al., "Hybrid restriction enzymes: zinc finger fusions to Fok I cleavage domain" *Proc. Natl Acad. Sci. USA.* 1996; 93:1156-1160; the entire contents of each are herein incorporated by reference). In some embodiments, the FokI DNA cleavage domain corresponds to, or comprises in part or whole, the amino acid sequence set forth as SEQ ID NO:6. In some embodiments, the FokI DNA cleavage domain is a variant of FokI (e.g., a variant of SEQ ID NO:6), as described herein. Other exemplary compositions and methods of using dCas9-nuclease fusion proteins can be found in U.S. patent application U.S. Ser. No. 14/320,498; titled "Cas9-FokI fusion Proteins and Uses Thereof," filed Jun. 30, 2014; the entire contents of which are incorporated herein by reference.

In some embodiments, the enzymatic domain comprises a recombinase or other catalytic domain thereof. For example, in some embodiments, the general architecture of exemplary ligand-dependent dCas9 fusion proteins with a recombinase domain comprises the structure:

[NH₂]-[NLS]-[dCas9]-[recombinase]-[COOH],
[NH₂]-[NLS]-[recombinase]-[dCas9HCOOH],
[NH₂]-[dCas9]-[recombinase]-[COOH], or
[NH₂]-[recombinase]-[dCas9]-[COOH];

wherein NLS is a nuclear localization signal, dCas9 comprises an intein as provided herein, NH₂ is the N-terminus of the fusion protein, and COOH is the C-terminus of the fusion protein. In some embodiments, a linker is inserted between the dCas9 and the recombinase domain. In some embodiments, a linker is inserted between the NLS and the recombinase and/or dCas9 domain. In some embodiments, the NLS is located C-terminal of the recombinase domain and/or the dCas9 domain. In some embodiments, the NLS is located between the recombinase domain and the dCas9 domain. Additional features, such as sequence tags, may also be present. By "catalytic domain of a recombinase," it is meant that a fusion protein includes a domain comprising an amino acid sequence of (e.g., derived from) a recombinase, such that the domain is sufficient to induce recombination when contacted with a target nucleic acid (either alone or with additional factors including other recombinase catalytic domains which may or may not form part of the fusion protein). In some embodiments, a catalytic domain of a recombinase does not include the DNA binding domain of the recombinase. In some embodiments, the catalytic domain of a recombinase includes part or all of a recombinase, e.g., the catalytic domain may include a recombinase domain and a DNA binding domain, or parts thereof, or the catalytic domain may include a recombinase domain and a DNA binding domain that is mutated or truncated to abolish DNA binding activity. Recombinases and catalytic domains of recombinases are known to those of skill in the art, and include, for example, those described herein. In some embodiments, the catalytic domain is derived from any recombinase. In some embodiments, the recombinase catalytic domain is a catalytic domain of a Tn3 resolvase, a Hin recombinase, or a Gin recombinase. In some embodiments, the catalytic domain comprises a Tn3 resolvase (e.g., Stark Tn3 recombinase) that is encoded by a nucleotide sequence comprising, in part or in whole, SEQ ID NO:44, as provided below. In some embodiments, a Tn3 catalytic domain is encoded by a variant of SEQ ID NO:44. In some embodiments, a Tn3 catalytic domain is encoded by a polynucleotide (or a variant thereof) that encodes the polypeptide corresponding to SEQ ID NO:45. In some embodiments, the catalytic domain comprises a Hin recombinase that is encoded by a nucleotide sequence comprising, in part or in whole, SEQ ID NO:46, as provided below. In some embodiments, a Hin catalytic domain is encoded by a variant of SEQ ID NO:46. In some embodiments, a Hin catalytic domain is encoded by a polynucleotide (or a variant thereof) that encodes the polypeptide corresponding to SEQ ID NO:47. In some embodiments, the catalytic domain comprises a Gin recombinase (e.g., Gin beta recombinase) that is encoded by a nucleotide sequence comprising, in part or in whole, SEQ ID NO:48, as provided below. In some embodiments, a Gin catalytic domain is encoded by a variant of SEQ ID NO:48. In some embodiments, a Gin catalytic domain is encoded by a polynucleotide (or a variant thereof) that encodes the polypeptide corresponding to SEQ ID NO:49. Other exemplary compositions and methods of using dCas9-recombinase fusion proteins can be found in U.S. patent application U.S. Ser. No. 14/320,467; titled "Cas9 Variants and Uses Thereof," filed Jun. 30, 2014; the entire contents of which are incorporated herein by reference.

```
Stark Tn3 recombinase (nucleotide: SEQ ID NO: 44;
amino acid: SEQ ID NO: 45):
                                       (SEQ ID NO: 44)
ATGGCCCTGTTTGGCTACGCACGCGTGTCTACCAGTCAACAGTCACTCGA

TTTGCAAGTGAGGGCTCTTAAAGATGCCGGAGTGAAGGCAAACAGAATTT

TTACTGATAAGGCCAGCGGAAGCAGCACAGACAGAGAGGGGCTGGATCTC

CTGAGAATGAAGGTAAAGGAGGGTGATGTGATCTTGGTCAAAAAATTGGA

TCGACTGGGGAGAGACACAGCTGATATGCTTCAGCTTATTAAAGAGTTTG

ACGCTCAGGGTGTTGCCGTGAGGTTTATCGATGACGGCATCTCAACCGAC

TCCTACATTGGTCTTATGTTTGTGACAATTTTGTCCGCTGTGGCTCAGGC

TGAGCGGAGAAGGATTCTCGAAAGGACGAATGAGGGACGGCAAGCAGCTA

AGTTGAAAGGTATCAAATTTGGCAGACGAAGG (SEQ ID NO: 45)
MALFGYARVSTSQQSLDLQVRALKDAGVKANRIFTDKASGSSTDREGLDL
LRMKVKEGDVILVKKLDRLGRDTADMLQLIKEFDAQGVAVRFIDDGISTD
SYIGLMFVTILSAVAQAERRRILERTNEGRQAAKLKGIKFGRRR

Hin Recombinase (nucleotide: SEQ ID NO: 46;
amino acid: SEQ ID NO: 47):
                                       (SEQ ID NO: 46)
ATGGCAACCATTGGCTACATAAGGGTGTCTACCATCGACCAAAATATCGA

CCTGCAGCGCAACGCTCTGACATCCGCCAACTGCGATCGGATCTTCGAGG

ATAGGATCAGTGGCAAGATCGCCAACCGGCCCGGTCTGAAGCGGGCTCTG

AAGTACGTGAATAAGGGCGATACTCTGGTTGTGTGGAAGTTGGATCGCTT

GGGTAGATCAGTGAAGAATCTCGTAGCCCTGATAAGCGAGCTGCACGAGA

GGGGTGCACATTTCCATTCTCTGACCGATTCCATCGATACGTCTAGCGCC

ATGGGCCGATTCTTCTTTTACGTCATGTCCGCCCTCGCTGAAATGGAGCG
```

```
CGAACTTATTGTTGAACGGACTTTGGCTGGACTGGCAGCGGCTAGAGCAC

AGGGCCGACTTGGA (SEQ ID NO: 47)
MATIGYIRVSTIDQNIDLQRNALTSANCDRIFEDRISGKIANRPGLKRAL
KYVNKGDTLVVWKLDRLGRSVKNLVALISELHERGAHFHSLTDSIDTSSA
MGRFFFYVMSALAEMERELIVERTLAGLAAARAQGRLG

Gin beta recombinase (nucleotide: SEQ ID NO: 48;
amino acid: SEQ ID NO: 49):
                                          (SEQ ID NO: 48)
ATGCTCATTGGCTATGTAAGGGTCAGCACCAATGACCAAAACACAGACTT

GCAACGCAATGCTTTGGTTTGCGCCGGATGTGAACAGATATTTGAAGATA

AACTGAGCGGCACTCGGACAGACAGACCTGGGCTTAAGAGAGCACTGAAA

AGACTGCAGAAGGGGGACACCCTGGTCGTCTGGAAACTGGATCGCCTCGG

ACGCAGCATGAAACATCTGATTAGCCTGGTTGGTGAGCTTAGGGAGAGAG

GAATCAACTTCAGAAGCCTGACCGACTCCATCGACACCAGTAGCCCCATG

GGACGATTCTTCTTCTATGTGATGGGAGCACTTGCTGAGATGGAAAGAGA

GCTTATTATCGAAAGAACTATGGCTGGTATCGCTGCTGCCCGGAACAAAG

GCAGACGGTTCGGCAGACCGCCGAAGAGCGGC (SEQ ID NO: 49)
MLIGYVRVSTNDQNTDLQRNALVCAGCEQIFEDKLSGTRTDRPGLKRALK
RLQKGDTLVVWKLDRLGRSMKHLISLVGELRERGINFRSLTDSIDTSSPM
GRFFFYVMGALAEMERELIIERTMAGIAAARNKGRRFGRPPKSG
```

In some embodiments, the enzymatic domain comprises a deaminase or a catalytic domain thereof. For example, in some embodiments, the general architecture of exemplary dCas9 fusion proteins with a deaminase enzyme or domain comprises the structure:

[NH$_2$]-[NLS]-[Cas9]-[deaminase]-[COOH],
[NH$_2$]-[NLS]-[deaminase]-[Cas9]-[COOH],
[NH$_2$]-[Cas9]-[deaminase]-[COOH], or
[NH$_2$][deaminase]-[Cas9]-[COOH];

wherein NLS is a nuclear localization signal, dCas9 comprises an intein as provided herein, NH$_2$ is the N-terminus of the fusion protein, and COOH is the C-terminus of the fusion protein. In some embodiments, a linker is inserted between the dCas9 and the deaminase domain. In some embodiments, a linker is inserted between the NLS and the deaminase and/or dCas9 domain. In some embodiments, the NLS is located C-terminal of the deaminase and/or the dCas9 domain. In some embodiments, the NLS is located between the deaminase domain and the dCas9 domain. Additional features, such as sequence tags, may also be present. One exemplary suitable type of nucleic acid-editing enzymes and domains are cytosine deaminases, for example, of the apolipoprotein B mRNA-editing complex (APOBEC) family of cytosine deaminase enzymes, including activation-induced cytidine deaminase (AID) and apolipoprotein B editing complex 3 (APOBEC3) enzyme. Another exemplary suitable type of nucleic acid-editing enzyme and domain thereof suitable for use in the present invention include adenosine deaminases. For example, an ADAT family adenosine deaminase can be fused to a dCas9 domain comprising an intein. Some exemplary suitable nucleic-acid editing enzymes and domains, e.g., deaminases and deaminase domains, that can be fused to dCas9 domains comprising inteins according to aspects of this disclosure are provided below. It will be understood that, in some embodiments, the active domain of the respective sequence can be used, e.g., the domain without a localizing signal (nuclear localizing signal, without nuclear export signal, cytoplasmic localizing signal). Other exemplary compositions and methods of using dCas9-nuclease fusion proteins can be found in U.S. patent application U.S. Ser. No. 14/325,815; titled "Fusions of Cas9 Domains and Nucleic Acid-Editing Domains," filed Jul. 8, 2014; the entire contents of which are incorporated herein by reference.

```
Human AID:
                                                                (SEQ ID NO: 50)
MDSLLMNRRKFLYQFKNVRWAKGRRETYLCYVVKRRDSATSFSLDFGYLRNKNGCHVELLFLRYISDWDLDPGRC
YRVTWFTSWSPCYDCARHVADFLRGNPNLSLRIFTARLYFCEDRKAEPEGLRRLHRAGVQIAIMTFKDYFYCWNT
FVENHERTFKAWEGLHENSVRLSRQLRRILLPLYEVDDLRDAFRTLGL
(underline: nuclear localization signal; double underline: nuclear export sig-
nal)

Mouse AID:
                                                                (SEQ ID NO: 51)
MDSLLMKQKKFLYHFKNVRWAKGRHETYLCYVVKRRDSATSCSLDFGHLRNKSGCHVELLFLRYISDWDLDPGRC

YRVTWFTSWSPCYDCARHVAEFLRWNPNLSLRIFTARLYFCEDRKAEPEGLRRLHRAGVQIGIMTFKDYFYCWNT

FVENRERTFKAWEGLHENSVRLTRQLRRILLPLYEVDDLRDAFRMLGF (underline: nuclear localization signal; double underline: nuclear export sig-
nal)

Dog AID:
                                                                (SEQ ID NO: 52)
MDSLLMKQRKFLYHFKNVRWAKGRHETYLCYVVKRRDSATSFSLDFGHLRNKSGCHVELLFLRYISDWDLDPGRC

YRVTWFTSWSPCYDCARHVADFLRGYPNLSLRIFAARLYFCEDRKAEPEGLRRLHRAGVQIAIMTFKDYFYCWNT

FVENREKTFKAWEGLHENSVRLSRQLRRILLPLYEVDDLRDAFRTLGL (underline: nuclear localization signal; double underline: nuclear export sig-
nal)
```

-continued

Bovine AID:
(SEQ ID NO: 53)

<u>MDSLLKKQRQFLYQFKNVRWAKGRHETYLC</u>YVVKRRDSPTSFSLDFGHLRNKAGCHVELLFLRYISDWDLDPGRC

YRVTWFTSWSPCYDCARHVADFLRGYPNLSLRIFTARLYFCDKERKAEPEGLRRLHRAGVQIAIMTFKDYFYCWN

TFVENHERTFKAWEGLHENSVRLSRQLRRILLP<u>LYEVDDLRDAFRTLGL</u>

(underline: nuclear localization signal; double underline: nuclear export signal)

Mouse APOBEC-3:
(SEQ ID NO: 54)

MGPFCLGCSHRKCYSPIRNLISQETFKFHFKNLGYAKGRKDTFLCYEVTRKDCDSPVSLHHGVFKNKDNI<u>HAEIC</u>

<u>FLYWFHDKVLKVLSPREEFKITWYMSWSPCFEC</u>AEQIVRFLATHHNLSLDIFSSRLYNVQDPETQQNLCRLVQEG

AQVAAMDLYEFKKCWKKFVDNGGRRFRPWKRLLTNFRYQDSKLQEILRPCYIPVPSSSSSTLSNICLTKGLPETR

FCVEGRRMDPLSEEEFYSQFYNQRVKHLCYYHRMKPYLCYQLEQFNGQAPLKGCLLSEKGKQ<u>HAEILFLDKIRSM</u>

<u>ELSQVTITCYLTWSPCPNC</u>AWQLAAFKRDRPDLILHIYTSRLYFHWKRPFQKGLCSLWQSGILVDVMDLPQFTDC

WTNFVNPKRPFWPWKGLEIISRRTQRRLRRIKESWGLQDLVNDFGNLQLGPPMS (underline: nucleic acid editing domain)

Rat APOBEC-3:
(SEQ ID NO: 55)

MGPFCLGCSHRKCYSPIRNLISQETFKFHFKNLRYAIDRKDTFLCYEVTRKDCDSPVSLHHGVFKNKDNI<u>HAEIC</u>

<u>FLYWFHDKVLKVLSPREEFKITWYMSWSPCFEC</u>AEQVLRFLATHHNLSLDIFSSRLYNIRDPENQQNLCRLVQEG

AQVAAMDLYEFKKCWKKFVDNGGRRFRPWKKLLTNFRYQDSKLQEILRPCYIPVPSSSSSTLSNICLTKGLPETR

FCVERRRVHLLSEEEFYSQFYNQRVKHLCYYHGVKPYLCYQLEQFNGQAPLKGCLLSEKGKQ<u>HAEILFLDKIRSM</u>

<u>ELSQVIITCYLTWSPCPNC</u>AWQLAAFKRDRPDLILHIYTSRLYFHWKRPFQKGLCSLWQSGILVDVMDLPQFTDC

WTNFVNPKRPFWPWKGLEIISRRTQRRLHRIKESWGLQDLVNDFGNLQLGPPMS (underline: nucleic acid editing domain)

Rhesus macaque APOBEC-3G:
(SEQ ID NO: 56)

<u>MVEPMDPRTFVSNFNNRPILSGLNTVWLCCEVKTKDPSGPPLDAKIFQGKVYSKAKY</u>*HPEMRFLRWFHKWRQLHH*

*DQEYKVTWYVSWSPCTRC*ANSVATFLAKDPKVTLTIFVARLYYFWKPDYQQALRILCQKRGGPHATMKIMNYNEF

QDCWNKFVDGRGKPFKPRNNLPKHYTLLQATLGELLRHLMDPGTFTSNFNNKPWVSGQHETYLCYKVERLHNDTW

VPLNQHRGFLRNQAPNIHGFPKGR*HAELCFLDLIPFWKLDGQQYRVTCFTSWSPCFSC*AQEMAKFISNNEHVSLC

IFAARIYDDQGRYQEGLRALHRDGAKIAMMNYSEFEYCWDTFVDRQGRPFQPWDGLDEHSQALSGRLRAI (bold italic: nucleic acid editing domain; underline: cytoplasmic localization signal)

Chimpanzee APOBEC-3G:
(SEQ ID NO: 57)

<u>MKPHFRNPVERMYQDTFSDNFYNRPILSHRNTVWLCYEVKTKGPSRPPLDAKIFRGQVYSKLKY</u>HPEMRFFHWFS

KWRKLHRDQEYEVTWYISWSPCTKCTRDVATFLAEDPKVTLTIFVARLYYFWDPDYQEALRSLCQKRDGPRATMK

IMNYDEFQHCWSKFVYSQRELFEPWNNLPKYYILLHIMLGEILRHSMDPPTFTSNFNNELWVRGRHETYLCYEVE

RLHNDTWVLLNQRRGFLCNQAPHKHGFLEGR<u>HAELCFLDVIPFWKLDLHQDYRVTCFTSWSPCFSC</u>AQEMAKFIS

NNKHVSLCIFAARIYDDQGRCQEGLRTLAKAGAKISIMTYSEFKHCWDTFVDHQGCPFQPWDGLEEHSQALSGRL

RAILQNQGN (underline: nucleic acid editing domain; double underline: cytoplasmic localization signal)

-continued

Green monkey APOBEC-3G:
(SEQ ID NO: 58)
<u>MNPQIRNMVEQMEPDIFVYYFNNRPILSGRNTVWLCYEVKTKDPSGPPLDANIFQGKLYPEAKD</u><u>HPEMKFLHWFR</u>

<u>KWRQLHRDQEYEVTWYVSWSPCTRC</u>ANSVATFLAEDPKVTLTIFVARLYYFWKPDYQQALRILCQERGGPHATMK

IMNYEFQHCWNEFVDGQGKPFKPRKNLPKHYTLLHATLGELLRHVMDPGTFTSNFNNKPWVSGQRETYLCYKVE

RSHNDTWVLLNQHRGFLRNQAPDRHGFPKGR<u>HAELCFLDLIPFWKLDDQQYRVTCFTSWSPCFSC</u>AQKMAKFISN

NKHVSLCIFAARIYDDQGRCQEGLRTLHRDGAKIAVMNYSEFEYCWDTFVDRQGRPFQPWDGLDEHSQALSGRLR

AI (underline: nucleic acid editing domain; double underline: cytoplasmic localization signal)

Human APOBEC-3G:
(SEQ ID NO: 59)
<u>MKPHFRNTVERMYRDTFSYNFYNRPILSRRNTVWLCYEVKTKGPSRPPLDAKIFRGQVYS</u>ELKY<u>HPEMRFFHWFS</u>

<u>KWRKLHRDQEYEVTWYISWSPCTKC</u>TRDMATFLAEDPKVTLTIFVARLYYFWDPDYQEALRSLCQKRDGPRATMK

IMNYDEFQHCWSKFVYSQRELFEPWNNLPKYYILLHIMLGEILRHSMDPPTFTFNFNNEPWVRGRHETYLCYEVE

RMHNDTWVLLNQRRGFLCNQAPHKHGFLEGR<u>HAELCFLDVIPFWKLDLDQDYRVTCFTSWSPCFSC</u>AQEMAKFIS

KNKHVSLCIFTARIYDDQGRCQEGLRTLAEAGAKISIMTYSEFKHCWDTFVDHQGCPFQPWDGLDEHSQDLSGRL

RAILQNQEN (underline: nucleic acid editing domain; double underline: cytoplasmic localization signal)

Human APOBEC-3F:
(SEQ ID NO: 60)
MKPHFRNTVERMYRDTFSYNFYNRPILSRRNTVWLCYEVKTKGPSRPRLDAKIFRGQVYSQPEH<u>HAEMCFLSWFC</u>

<u>GNQLPAYKCFQITWFVSWTPCPDC</u>VAKLAEFLAEHPNVTLTISAARLYYYWERDYRRALCRLSQAGARVKIMDDE

EFAYCWENFVYSEGQPFMPWYKFDDNYAFLHRTLKEILRNPMEAMYPHIFYFHFKNLRKAYGRNESWLCFTMEVV

KHHSPVSWKRGVFRNQVDPETHC<u>HAERCFLSWFCDDILSPNTNYEVTWYTSWSPCPEC</u>AGEVAEFLARHSNVNLT

IFTARLYYFWDTDYQEGLRSLSQEGASVEIMGYKDFKYCWENFVYNDDEPFKPWKGLKYNFLFLDSKLQEILE (underline: nucleic acid editing domain)

Human APOBEC-3B:
(SEQ ID NO: 61)
MNPQIRNPMERMYRDTFYDNFENEPILYGRSYTWLCYEVKIKRGRSNLLWDTGVFRGQVYFKPQY<u>HAEMCFLSWF</u>

<u>CGNQLPAYKCFQITWFVSWTPCPDC</u>VAKLAEFLSEHPNVTLTISAARLYYYWERDYRRALCRLSQAGARVTIMDY

EEFAYCWENFVYNEGQQFMPWYKFDENYAFLHRTLKEILRYLMDPDTFTFNFNNDPLVLRRRQTYLCYEVERLDN

GTWVLMDQHMGFLCNEAKNLLCGFY<u>GRHAELRFLDLVPSLQLDPAQIYRVTWFISWSPCFSWGC</u>AGEVRAFLQEN

THVRLRIFAARIYDYDPLYKEALQMLRDAGAQVSIMTYDEFEYCWDTFVYRQGCPFQPWDGLEEHSQALSGRLRA

ILQNQGN (underline: nucleic acid editing domain)

Human APOBEC-3C:
(SEQ ID NO: 62)
MNPQIRNPMKAMYPGTFYFQFKNLWEANDRNETWLCFTVEGIKRRSVVSWKTGVFRNQVDSETH<u>CHAERCFLSWF</u>

<u>CDDILSPNTKYQVTWYTSWSPCPDC</u>AGEVAEFLARHSNVNLTIFTARLYYFQYPCYQEGLRSLSQEGVAVEIMDY

EDFKYCWENFVYNDNEPFKPWKGLKTNFRLLKRRLRESLQ (underline: nucleic acid editing domain)

-continued

Human APOBEC-3A:
(SEQ ID NO: 63)
MEASPASGPRHLMDPHIFTSNFNNGIGRHKTYLCYEVERLDNGTSVKMDQHRGFLHNQAKNLLCGFYGRHAELRF

LDLVPSLQLDPAQIYRVTWFISWSPCFSWGCAGEVRAFLQENTHVRLRIFAARIYDYDPLYKEALQMLRDAGAQV

SIMTYDEFKHCWDTFVDHQGCPFQPWDGLDEHSQALSGRLRAILQNQGN (underline: nucleic acid editing domain)

Human APOBEC-3H:
(SEQ ID NO: 64)
MALLTAETFRLQFNNKRRLRRPYYPRKALLCYQLTPQNGSTPTRGYFENKKKCHAEICFINEIKSMGLDETQCYQ

VTCYLTWSPCSSCAWELVDFIKAHDHLNLGIFASRLYYHWCKPQQKGLRLLCGSQVPVEVMGFPKFADCWENFVD

HEKPLSFNPYKMLEELDKNSRAIKRRLERIKIPGVRAQGRYMDILCDAEV (underline: nucleic acid editing domain)

Human APOBEC-3D:
(SEQ ID NO: 65)
MNPQIRNPMERMYRDTFYDNFENEPILYGRSYTWLCYEVKIKRGRSNLLWDTGVFRGPVLPKRQSNHRQEVYFRF

ENHAEMCFLSWFCGNRLPANRRFQITWFVSWNPCLPCVVKVTKFLAEHPNVTLTISAARLYYYRDRDWRWVLLRL

HKAGARVKIMDYEDFAYCWENFVCNEGQPFMPWYKFDDNYASLHRTLKEILRNPMEAMYPHIFYFHFKNLLKACG

RNESWLCFTMEVTKHHSAVFRKRGVFRNQVDPETHCHAERCFLSWFCDDILSPNTNYEVTWYTSWSPCPECAGEV

AEFLARHSNVNLTIFTARLCYFWDTDYQEGLCSLSQEGASVKIMGYKDFVSCWKNFVYSDDEPFKPWKGLQTNFR

LLKRRLREILQ (underline: nucleic acid editing domain)

Human APOBEC-1:
(SEQ ID NO: 66)
MTSEKGPSTGDPTLRRRIEPWEFDVFYDPRELRKEACLLYEIKWGMSRKIWRSSGKNTTNHVEVNFIKKFTSERD

FHPSMSCSITWFLSWSPCWECSQAIREFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQNHLTFFRLHLQNCHYQTIPPHILLA

TGLIHPSVAWR

Mouse APOBEC-1:
(SEQ ID NO: 67)
MSSETGPVAVDPTLRRRIEPHEFEVFFDPRELRKETCLLYEINWGGRHSVWRHTSQNTSNHVEVNFLEKFTTERY

FRPNTRCSITWFLSWSPCGECSRAITEFLSRHPYVTLFIYIARLYHHTDQRNRQGLRDLISSGVTIQIMTEQEYC

YCWRNFVNYPPSNEAYWPRYPHLWVKLYVLELYCIILGLPPCLKILRRKQPQLTFFTITLQTCHYQRIPPHLLWA

TGLK

Rat APOBEC-1:
(SEQ ID NO: 68)
MSSETGPVAVDPTLRRRIEPHEFEVFFDPRELRKETCLLYEINWGGRHSIWRHTSQNTNKHVEVNFIEKFTTERY

FCPNTRCSITWFLSWSPCGECSRAITEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQPQLTFFTIALQSCHYQRLPPHILWA

TGLK

Human ADAT-2:
(SEQ ID NO: 69)
MEAKAAPKPAASGACSVSAEETEKWMEEAMHMAKEALENTEVPVGCLMVYNNEVVGKGRNEVNQTKNATRHAEMV

AIDQVLDWCRQSGKSPSEVFEHTVLYVTVEPCIMCAAALRLMKIPLVVYGCQNERFGGCGSVLNIASADLPNTGR

PFQCIPGYRAEEAVEMLKTFYKQENPNAPKSKVRKKECQKS

Mouse ADAT-2:

(SEQ ID NO: 70)
MEEKVESTTTPDGPCVVSVQETEKWMEEAMRMAKEALENIEVPVGCLMVYNNEVVGKGRNEVNQTKNATRHAEMV

AIDQVLDWCHQHGQSPSTVFEHTVLYVTVEPCIMCAAALRLMKIPLVVYGCQNERFGGCGSVLNIASADLPNTGR

PFQCIPGYRAEEAVELLKTFYKQENPNAPKSKVRKKDCQKS

Mouse ADAT-1:

(SEQ ID NO: 71)
MWTADEIAQLCYAHYNVRLPKQGKPEPNREWTLLAAVVKIQASANQACDIPEKEVQVTKEVVSMGTGTKCIGQSK

MRESGDILNDSHAEIIARRSFQRYLLHQLHLAAVLKEDSIFVPGTQRGLWRLRPDLSFVFFSSHTPCGDASIIPM

LEFEEQPCCPVIRSWANNSPVQETENLEDSKDKRNCEDPASPVAKKMRLGTPARSLSNCVAHHGTQESGPVKPDV

SSSDLTKEEPDAANGIASGSFRVVDVYRTGAKCVPGETGDLREPGAAYHQVGLLRVKPGRGDRTCSMSCSDKMAR

WNVLGCQGALLMHFLEKPIYLSAVVIGKCPYSQEAMRRALTGRCEETLVLPRGFGVQELEIQQSGLLFEQSRCAV

HRKRGDSPGRLVPCGAAISWSAVPQQPLDVTANGFPQGTTKKEIGSPRARSRISKVELFRSFQKLLSSIADDEQP

DSIRVTKKLDTYQEYKDAASAYQEAWGALRRIQPFASWIRNPPDYHQFK (underline:

nucleic acid editing domain)

Human ADAT-1:

(SEQ ID NO: 72)
MWTADEIAQLCYEHYGIRLPKKGKPEPNHEWTLLAAVVKIQSPADKACDTPDKPVQVTKEVVSMGTGTKCIGQSK

MRKNGDILNDSHAEVIARRSFQRYLLHQLQLAATLKEDSIFVPGTQKGVWKLRRDLIFVFFSSHTPCGDASIIPM

LEFEDQPCCPVFRNWAHNSSVEASSNLEAPGNERKCEDPDSPVTKKMRLEPGTAAREVTNGAAHHQSFGKQKSGP

ISPGIHSCDLTVEGLATVTRIAPGSAKVIDVYRTGAKCVPGEAGDSGKPGAAFHQVGLLRVKPGRGDRTRSMSCS

DKMARWNVLGCQGALLMHLLEEPIYLSAVVIGKCPYSQEAMQRALIGRCQNVSALPKGFGVQELKILQSDLLFEQ

SRSAVQAKRADSPGRLVPCGAAISWSAVPEQPLDVTANGFPQGTTKKTIGSLQARSQISKVELFRSFQKLLSRIA

RDKWPHSLRVQKLDTYQEYKEAASSYQEAWSTLRKQVFGSWIRNPPDYHQFK (underline: nucleic acid editing domain)

In some embodiments, the enzymatic domain comprises one or more of a transcriptional activator. For example, in some embodiments, the general architecture of exemplary dCas9 fusion proteins with a transcriptional activator domain comprises the structure:

[NH$_2$]-[NLS]-[Cas9]-[(transcriptional activator)$_n$]-[COOH],

[NH$_2$]-[NLS]-[(transcriptional activator)$_n$]-[Cas9]-[COOH],

[NH$_2$]-[Cas9]-[(transcriptional activator)$_n$]-[COOH], or

[NH$_2$]-[(transcriptional activator)$_n$]-[Cas9]-[COOH];

wherein NLS is a nuclear localization signal, dCas9 comprises an intein as provided herein, NH$_2$ is the N-terminus of the fusion protein, and COOH is the C-terminus of the fusion protein. In some embodiments, the fusion proteins comprises one or more repeats of the transcriptional activator, for example wherein n=1-10 (e.g., n is 1, 2, 3, 4, 5, 6, 7, 8, 9, or 10). In some embodiments, n=1-20. In some embodiments, a linker is inserted between the dCas9 and the transcriptional activator domain. In some embodiments, a linker is inserted between the NLS and the transcriptional activator and/or dCas9 domain. In some embodiments, the NLS is located C-terminal of the transcriptional activator and/or the dCas9 domain. In some embodiments, the NLS is located between the transcriptional activator domain and the dCas9 domain. Additional features, such as sequence tags, may also be present. In some embodiments, the transcriptional activator is selected from the group consisting of VP64, (SEQ ID NO:73), VP16 (SEQ ID NO:74), and p65 (SEQ ID NO:75).

VP64

(SEQ ID NO: 73)
GSGRADALDDFDLDMLGSDALDDFDLDMLGSDALDDFDLDMLGSDALDD

FDLDMLIN

VP16

(SEQ ID NO: 74)
APPTDVSLGDELHLDGEDVAMAHADALDDFDLDMLGDGDSPGPGFTPHD

SAPYGALDMADFEFEQMFTDALGIDEYGGEFPGIRR p65:

(SEQ ID NO: 75)
PSGQISNQALALAPSSAPVLAQTMVPSSAMVPLAQPPAPAPVLTPGPPQ

SLSAPVPKSTQAGEGTLSEALLHLQFDADEDLGALLGNSTDPGVFTDLA

SVDNSEFQQLLNQGVSMSHSTAEPMLMEYPEAITRLVTGSQRPPDPAPT

PLGTSGLPNGLSGDEDFSSIADMDFSALLSQISSSGQ

In some embodiments, the enzymatic domain comprises one or more of a transcriptional repressor. For example, in some embodiments, the general architecture of exemplary dCas9 fusion proteins with a transcriptional repressor domain comprises the structure:

[NH₂]-[NLS]-[Cas9]-[(transcriptional repressor)ₙ]-[COOH],
[NH₂]-[NLS]-[(transcriptional repressor)ₙ]-[Cas9]-[COOH],
[NH₂]-[Cas9]-[(transcriptional repressor)ₙ]-[COOH], or
[NH₂]-[(transcriptional repressor)ₙ]-[Cas9]-[COOH];

wherein NLS is a nuclear localization signal, dCas9 comprises an intein as provided herein, NH₂ is the N-terminus of the fusion protein, and COOH is the C-terminus of the fusion protein. In some embodiments, the fusion proteins comprises one or more repeats of the transcriptional repressor, for example wherein n=1-10 (e.g., n is 1, 2, 3, 4, 5, 6, 7, 8, 9, or 10). In some embodiments, n=1-20. In some embodiments, a linker is inserted between the dCas9 and the transcriptional repressor domain. In some embodiments, a linker is inserted between the NLS and the transcriptional repressor and/or dCas9 domain. In some embodiments, the NLS is located C-terminal of the transcriptional repressor and/or the dCas9 domain. In some embodiments, the NLS is located between the transcriptional repressor domain and the dCas9 domain. Additional features, such as sequence tags, may also be present. In some embodiments, the transcriptional repressor is selected from the group consisting of the KRAB (Krüppel associated box) domain of Kox1, SID (mSin3 interaction domain), the CS (Chromo Shadow) domain of HP1α, or the WRPW domain of Hes1. These and other repressor domains are known in the art, and in some embodiments correspond to those described in Urrutia, KRAB-containing zinc-finger repressor proteins. *Genome Biol.* 2003; 4(10):231; Gilbert et al. CRISPR-mediated modular RNA-guided regulation of transcription in eukaryotes. *Cell.* 2013; 154, 442-451; Konermann et al., Optical control of mammalian endogenous transcription and epigenetic states. *Nature.* 2013; 500, 472-476; and published U.S. patent application U.S. Ser. No. 14/105,017, published as U.S. 2014/0186958 A1, the entire contents of which are incorporated herein by reference. In some embodiments, the transcription repressor domain comprises one or more repeats (e.g., 2, 3, 4, 5, 6, 7, 8, 9, or 10 repeats) of a KRAB domain. In some embodiments, the KRAB domain comprises an amino acid sequence selected from the group consisting of SEQ ID NOs:76-79. In some embodiments, the transcriptional repressor domains comprises one or more repeats of a SID protein. In some embodiments, the SID protein comprises an amino acid sequence set forth as SEQ ID NO:80. In some embodiments, the repressor domain comprises 2, 3, 4, 5, 6, 7, 8, 9, or 10 repeats of a SID protein (e.g., SEQ ID NO:80). In some embodiments, the repressor domain comprises four repeats of SID (e.g., SID4x; SEQ ID NO:81).

KRAB (human; GenBank: AAD20972.1)
(SEQ ID NO: 76)
MNMFKEAVTFKDVAVAFTEEELGLLGPAQRKLYRDVMVENFRNLLSVGH

PPFKQDVSPIERNEQLWIMTTATRRQGNLDTLPVKALLLYDLAQT

KRAB protein domain, partial (human; GenBank: CAB52478.1):
(SEQ ID NO: 77)
EQVSFKDVCVDFTQEEWYLLDPAQKILYRDVILENYSNLVSVGYCITKP

EVIFKIEQGEEPWILEKGFPSQCHP

KRAB A domain, partial (human; GenBank: AAB03530.1):
(SEQ ID NO: 78)
EAVTFKDVAVVFTEEELGLLDPAQRKLYRDVMLENFRNLLSV -continued KRAB (mouse; C2H2 type domain containing protein; GenBank: CAM27971.1):
(SEQ ID NO: 79)
MDLVTYDDVHVNFTQDEWALLDPSQKSLYKGVMLETYKNLTAIGYIWEE

HTIEDHFQTSRSHGSNKKTH

SID repressor domain:
(SEQ ID NO: 80)
GSGMNIQMLLEAADYLERREREAEHGYASMLP

SID4x repressor domain:
(SEQ ID NO: 81)
GSGMNIQMLLEAADYLERREREAEHGYASMLPGSGMNIQMLLEAADYLE

RREREAEHGYASMLPGSGMNIQMLLEAADYLERREREAEHGYASMLPGS

GMNIQMLLEAADYLERREREAEHGYASMLPSR

In some embodiments, the enzymatic domain comprises an epigenetic modifier or a catalytic domain thereof. For example, in some embodiments, the general architecture of exemplary dCas9 fusion proteins with an epigenetic modifier or domain comprises the structure:
[NH₂]-[NLS]-[Cas9]-[epigenetic modifier]-[COOH],
[NH₂]-[NLS]-[epigenetic modifier]-[Cas9]-[COOH],
[NH₂]-[Cas9]-[epigenetic modifier]-[COOH], or
[NH₂]-[epigenetic modifier]-[Cas9]-[COOH];

wherein NLS is a nuclear localization signal, dCas9 comprises an intein as provided herein, NH₂ is the N-terminus of the fusion protein, and COOH is the C-terminus of the fusion protein. In some embodiments, a linker is inserted between the dCas9 and the epigenetic modifier domain. In some embodiments, a linker is inserted between the NLS and the epigenetic modifier and/or dCas9 domain. In some embodiments, the NLS is located C-terminal of the epigenetic modifier and/or the dCas9 domain. In some embodiments, the NLS is located between the epigenetic modifier domain and the dCas9 domain. Additional features, such as sequence tags, may also be present. Epigenetic modifiers are well known in the art, and typically catalyze DNA methylation (and demethylation) or histone modifications (e.g., histone methylation/demethylation, acetylation/deacetylation, ubiquitylation, phosphorylation, sumoylation, etc.). The presence of one more epigenetic modifications can affect the transcriptional activity of one or more genes, for example turning genes from an "on" state to an "off" state, and vice versa. Epigenetic modifiers include, but are not limited to, histone demethylase, histone methyltransferase, hydroxylase, histone deacetylase, and histone acetyltransferase. Exemplary epigenetic modifying proteins can be found in Konermann et al., Optical control of mammalian endogenous transcription and epigenetic states. *Nature.* 2013; 500, 472-476; Mendenhall et al., Locus-specific editing of histone modifications at endogenous enhancers. *Nat. Biotechnol.* 2013; 31, 1133-1136; and Maeder et al., Targeted DNA demethylation and activation of endogenous genes using programmable TALE-TET1 fusion proteins. *Nat. Biotechnol.* 2013; 31, 1137-1142; the entire contents of each are incorporated herein by reference. In some embodiments, the epigenetic modifier domain is LSD1 (Lysine (K)-specific demethylase 1A) histone demethylase, which in some embodiments, comprises in whole or in part, an amino acid sequence set forth as SEQ ID NO:82 or SEQ ID NO:83. In some embodiments, the epigenetic modifier domain is TET1 hydroxylase catalytic domain, which in some embodiments, comprises an amino acid sequence set forth as SEQ ID NO:84. In some embodiments, the epigenetic modifier is a histone deacetylase (HDAC) effector domain. In some embodiments, the HDAC effector domain comprises in whole in in part, an amino acid sequence corresponding to any of the HDAC effector proteins provided in Supplementary Table 2 of Konermann et al., Optical control of mammalian endogenous transcription and epigenetic states. *Nature.* 2013; 500, 472-476; SEQ ID NOs:85-96. In some embodiments, the epigenetic modifier is a histone methyltransferase (HMT) effector domain. In some embodiments, the HMT effector domain comprises in whole in in part, an amino acid sequence corresponding to any of the HDAC effector proteins provided in Supplementary Table 3 of Konermann et al., Optical control of mammalian endogenous transcription and epigenetic states. *Nature.* 2013; 500, 472-476; SEQ ID NOs:97-106.

```
LSD1, isoform a (human):
                                                      (SEQ ID NO: X)
MLSGKKAAAAAAAAAAAAATGTEAGPGTAGGSENGSEVAAQPAGLSGPAEVGPGAVGERTPRKKEPPRA

SPPGGLAEPPGSAGPQAGPTVVPGSATPMETGIAETPEGRRTSRRKRAKVEYREMDESLANLSEDEYY

SEEERNAKAEKEKKLPPPPPQAPPEEENESEPEEPSGQAGGLQDDSSGGYGDGQASGVEGAAFQSRLP

HDRMTSQEAACFPDIISGPQQTQKVFLFIRNRTLQLWLDNPKIQLTFEATLQQLEAPYNSDTVLVHRV

HSYLERHGLINFGIYKRIKPLPTKKTGKVIIIGSGVSGLAAARQLQSFGMDVTLLEARDRVGGRVATF

RKGNYVADLGAMVVTGLGGNPMAVVSKQVNMELAKIKQKCPLYEANGQADTVKVPKEKDEMVEQEFNR

LLEATSYLSHQLDFNVLNNKPVSLGQALEVVIQLQEKHVKDEQIEHWKKIVKTQEELKELLNKMVNLK

EKIKELHQQYKEASEVKPPRDITAEFLVKSKHRDLTALCKEYDELAETQGKLEEKLQELEANPPSDVY

LSSRDRQILDWHFANLEFANATPLSTLSLKHWDQDDDFEFTGSHLTVRNGYSCVPVALAEGLDIKLNT

AVRQVRYTASGCEVIAVNTRSTSQTFIYKCDAVLCTLPLGVLKQQPPAVQFVPPLPEWKTSAVQRMGF

GNLNKVVLCFDRVFWDPSVNLFGHVGSTTASRGELFLFWNLYKAPILLALVAGEAAGIMENISDDVIV

GRCLAILKGIFGSSAVPQPKETVVSRWRADPWARGSYSYVAAGSSGNDYDLMAQPITPGPSIPGAPQP

IPRLFFAGEHTIRNYPATVHGALLSGLREAGRIADQFLGAMYTLPRQATPGVPAQQSPSM

LSD1, isoform b (human):
                                                      (SEQ ID NO: X)
MLSGKKAAAAAAAAAAAAATGTEAGPGTAGGSENGSEVAAQPAGLSGPAEVGPGAVGERTPRKKEPPRA

SPPGGLAEPPGSAGPQAGPTVVPGSATPMETGIAETPEGRRTSRRKRAKVEYREMDESLANLSEDEYY

SEEERNAKAEKEKKLPPPPPQAPPEEENESEPEEPSGVEGAAFQSRLPHDRMTSQEAACFPDIISGPQ

QTQKVFLFIRNRTLQLWLDNPKIQLTFEATLQQLEAPYNSDTVLVHRVHSYLERHGLINFGIYKRIKP

LPTKKTGKVIIIGSGVSGLAAARQLQSFGMDVTLLEARDRVGGRVATFRKGNYVADLGAMVVTGLGGN

PMAVVSKQVNMELAKIKQKCPLYEANGQAVPKEKDEMVEQEFNRLLEATSYLSHQLDFNVLNNKPVSL

GQALEVVIQLQEKHVKDEQIEHWKKIVKTQEELKELLNKMVNLKEKIKELHQQYKEASEVKPPRDITA

EFLVKSKHRDLTALCKEYDELAETQGKLEEKLQELEANPPSDVYLSSRDRQILDWHFANLEFANATPL

STLSLKHWDQDDDFEFTGSHLTVRNGYSCVPVALAEGLDIKLNTAVRQVRYTASGCEVIAVNTRSTSQ

TFIYKCDAVLCTLPLGVLKQQPPAVQFVPPLPEWKTSAVQRMGFGNLNKVVLCFDRVFWDPSVNLFGH

VGSTTASRGELFLFWNLYKAPILLALVAGEAAGIMENISDDVIVGRCLAILKGIFGSSAVPQPKETVV

SRWRADPWARGSYSYVAAGSSGNDYDLMAQPITPGPSIPGAPQPIPRLFFAGEHTIRNYPATVHGALL

SGLREAGRIADQFLGAMYTLPRQATPGVPAQQSPSM

TET1 catalytic domain:
                                                      (SEQ ID NO: X)
SIVAQLSRPDPALAALTNDHLVALACLGGRPALDAVKKGLPHAPALIKRTNRRIPERTSHRVADHAQV

VRVLGFFQCHSHPAQAFDDAMTQFGMSGGGSLPTCSCLDRVIQKDKGPYYTHLGAGPSVAAVREIMEN

RYGQKGNAIRIEIVVYTGKEGKSSHGCPIAKWVLRRSSDEEKVLCLVRQRTGHHCPTAVMVVLIMVWD

GIPLPMADRLYTELTENLKSYNGHPTDRRCTLNENRTCTCQGIDPETCGASFSFGCSWSMYFNGCKFG

RSPSPRRFRIDPSSPLHEKNLEDNLQSLATRLAPIYKQYAPVAYQNQVEYENVARECRLGSKEGRPFS

GVTACLDFCAHPHRDIHNMNNGSTVVCTLTREDNRSLGVIPQDEQLHVLPLYKLSDTDEFGSKEGMEA

KIKSGAIEVLAPRRKKRTCFTQPVPRSGKKRAAMMTEVLAHKIRAVEKKPIPRIKRKNNSTTTNNSKP
```

SSLPTLGSNTETVQPEVKSETEPHFILKSSDNTKTYSLMPSAPHPVKEASPGFSWSPKTASATPAPLK

NDATASCGFSERSSTPHCTMPSGRLSGANAAAADGPGISQLGEVAPLPTLSAPVMEPLINSEPSTGVT

EPLTPHQPNHQPSFLTSPQDLASSPMEEDEQHSEADEPPSDEPLSDDPLSPAEEKLPHIDEYWSDSEH

IFLDANIGGVAIAPAHGSVLIECARRELHATTPVEHPNRNHPTRLSLVFYQHKNLNKPQHGFELNKIK

FEAKEAKNKKMKASEQKDQAANEGPEQSSEVNELNQIPSHKALTLTHDNVVTVSPYALTHVAGPYNHW

V

HDAC effector domains:
HDAC8 (*X. laevis*):
(SEQ ID NO: 85)
ASSPKKKRKVEASMSRVVKPKVASMEEMAAFHTDAYLQHLHKVSEEGDNDDPETLEYGLGYDCPITEG

IYDYAAAVGGATLTAAEQLIEGKTRIAVNWPGGWHHAKKDEASGFCYLNDAVLGILKLREKFDRVLYV

DMDLHHGDGVEDAFSFTSKVMTVSLHKFSPGFFPGTGDVSDIGLGKGRYYSINVPLQDGIQDDKYYQI

CEGVLKEVFTTFNPEAVVLQLGADTIAGDPMCSFNMTPEGIGKCLKYVLQWQLPTLILGGGGYHLPNT

ARCWTYLTALIVGRTLSSEIPDHEFFTEYGPDYVLEITPSCRPDRNDTQKVQEILQSIKGNLKRVVEF

RPD3 (*S. cerevisiae*):
(SEQ ID NO: 86)
ASSPKKKRKVEASRRVAYFYDADVGNYAYGAGHPMKPHRIRMAHSLIMNYGLYKKMEIYRAKPATKQE

MCQFHTDEYIDFLSRVTPDNLEMFKRESVKFNVGDDCPVFDGLYEYCSISGGGSMEGAARLNRGKCDV

AVNYAGGLHHAKKSEASGFCYLNDIVLGIIELLRYHPRVLYIDIDVHHGDGVEEAFYTTDRVMTCSFH

KYGEFFPGTGELRDIGVGAGKNYAVNVPLRDGIDDATYRSVFEPVIKKIMEWYQPSAVVLQCGGDSLS

GDRLGCFNLSMEGHANCVNYVKSFGIPMMVVGGGGYTMRNVARTWCFETGLLNNVVLDKDLPYEF

MesoLo4 (*M. loti*):
(SEQ ID NO: 87)
ASSPKKKRKVEASMPLQIVHHPDYDAGFATNHRFPMSKYPLLMEALRARGLASPDALNTTEPAPASWL

KLAHAADYVDQVISCSVPEKIEREIGFPVGPRVSLRAQLATGGTILAARLALRHGIACNTAGGSHHAR

RAQGAGFCTFNDVAVASLVLLDEGAAQNILVVDLDVHQGDGTADILSDEPGVFTFSMHGERNYPVRKI

ASDLDIALPDGTGDAAYLRRLATILPELSARARWDIVFYNAGVDVHAEDRLGRLALSNGGLRARDEMV

IGHFRALGIPVCGVIGGGYSTDVPALASRHAILFEVASTYAEF

HDAC11 (human):
(SEQ ID NO: 88)
ASSPKKKRKVEASMLHTTQLYQHVPETRWPIVYSPRYNITFMGLEKLHPFDAGKWGKVINFLKEEKLL

SDSMLVEAREASEEDLLVVHTRRYLNELKWSFAVATITEIPPVIFLPNFLVQRKVLRPLRTQTGGTIM

AGKLAVERGWAINVGGGFHHCSSDRGGGFCAYADITLAIKFLFERVEGISRATIIDLDAHQGNGHERD

FMDDKRVYIMDVYNRHIYPGDRFAKQAIRRKVELEWGTEDDEYLDKVERNIKKSLQEHLPDVVVYNAG

TDILEGDRLGGLSISPAGIVKRDELVFRMVRGRRVPILMVTSGGYQKRTARIIADSILNLFGLGLIGP

ESPSVSAQNSDTPLLPPAVPEF

HDT1 (*A. thaliana*):
(SEQ ID NO: 89)
ASSPKKKRKVEASMEFWGIEVKSGKPVTVTPEEGILIHVSQASLGECKNKKGEFVPLHVKVGNQNLVL

GTLSTENIPQLFCDLVFDKEFELSHTWGKGSVYFVGYKTPNIEPQGYSEEEEEEEEEVPAGNAAKAVA

KPKAKPAEVKPAVDDEEDESDSDGMDEDDSDGEDSEEEEPTPKKPASSKKRANETTPKAPVSAKKAKV

AVTPQKTDEKKKGGKAANQSEF

SIRT3 (human):
(SEQ ID NO: 90)
ASSPKKKRKVEASMVGAGISTPSGIPDFRSPGSGLYSNLQQYDLPYPEAIFELPFFFHNPKPFFTLAK

ELYPGNYKPNVTHYFLRLLHDKGLLLRLYTQNIDGLERVSGIPASKLVEAHGTFASATCTVCQRPFPG

EDIRADVMADRVPRCPVCTGVVKPDIVFFGEPLPQRFLLHVVDFPMADLLLILGTSLEVEPFASLTEA

VRSSVPRLLINRDLVGPLAWHPRSRDVAQLGDVVHGVESLVELLGWTEEMRDLVQRETGKLDGPDKEF

HST2 (*S. cerevisiae*):
(SEQ ID NO: 91)
ASSPKKKRKVEASTEMSVRKIAAHMKSNPNAKVIFMVGAGISTSCGIPDFRSPGTGLYHNLARLKLPY

PEAVFDVDFFQSDPLPFYTLAKELYPGNFRPSKFHYLLKLFQDKDVLKRVYTQNIDTLERQAGVKDDL

IIEAHGSFAHCHCIGCGKVYPPQVFKSKLAEHPIKDFVKCDVCGELVKPAIVFFGEDLPDSFSETWLN

DSEWLREKITTSGKHPQQPLVIVVGTSLAVYPFASLPEEIPRKVKRVLCNLETVGDFKANKRPTDLIV

HQYSDEFAEQLVEELGWQEDFEKILTAQGGMGEF

CobB (*E. coli* (K12)):
(SEQ ID NO: 92)
ASSPKKKRKVEASMEKPRVLVLTGAGISAESGIRTFRAADGLWEEHRVEDVATPEGFDRDPELVQAFY

NARRRQLQQPEIQPNAAHLALAKLQDALGDRFLLVTQNIDNLHERAGNTNVIHMHGELLKVRCSQSGQ

VLDWTGDVTPEDKCHCCQFPAPLRPHVVWFGEMPLGMDEIYMALSMADIFIAIGTSGHVYPAAGFVHE

AKLHGAHTVELNLEPSQVGNEFAEKYYGPASQVVPEFVEKLLKGLKAGSIAEF

HST2 (*C. albicans*):
(SEQ ID NO: 93)
ASSPKKKRKVEASMPSLDDILKPVAEAVKNGKKVTFFNGAGISTGAGIPDFRSPDTGLYANLAKLNLP

FAEAVFDIDFFKEDPKPFYTLAEELYPGNFAPTKFHHFIKLLQDQGSLKRVYTQNIDTLERLAGVEDK

YIVEAHGSFASNHCVDCHKEMTTETLKTYMKDKKIPSCQHCEGYVKPDIVFFGEGLPVKFFDLWEDDC

EDVEVAIVAGTSLTVFPPFASLPGEVNKKCLRVLVNKEKVGTFKHEPRKSDIIALHDCDIVAERLCTLL

GLDDKLNEVYEKEKIKYSKAETKEIKMHEIEDKLKEEAHLKEDKHTTKVDKKEKQNDANDKELEQLID

KAKAEF

SIRT5 (human):
(SEQ ID NO: 94)
ASSPKKKRKVEASSSSMADFRKFFAKAKHIVIISGAGVSAESGVPTFRGAGGYWRKWQAQDLATPLAF

AHNPSRVWEFYHYRREVMGSKEPNAGHRAIAECETRLGKQGRRVVVITQNIDELHRKAGTKNLLEIHG

SLFKTRCTSCGVVAENYKSPICPALSGKGAPEPGTQDASIPVEKLPRCEEAGCGGLLRPHVVWFGENL

DPAILEEVDRELAHCDLCLVVGTSSVVYPAAMFAPQVAARGVPVAEFNTETTPATNRFRFHFQGPCGT

TLPEALACHENETVSEF

Sir2A (*P. falciparum*):
(SEQ ID NO: 95)
ASSPKKKRKVEASMGNLMISFLKKDTQSITLEELAKIIKKCKHVVALTGSGTSAESNIPSFRGSSNSI

WSKYDPRIYGTIWGFWKYPEKIWEVIRDISSDYEIEINNGHVALSTLESLGYLKSVVTQNVDGLHEAS

GNTKVISLHGNVFEAVCCTCNKIVKLNKIMLQKTSHFMHQLPPECPCGGIFKPNIILFGEVVSSDLLK

EAEEEIAKCDLLLVIGTSSTVSTATNLCHFACKKKKKIVEINISKTYITNKMSDYHVCAKFSELTKVA

NILKGSSEKNKKIMEF

SIRT6 (human):
(SEQ ID NO: 96)
ASSPKKKRKVEASMSVNYAAGLSPYADKGKCGLPEIFDPPEELERKVWELARLVWQSSSVVFHTGAGI

STASGIPDFRGPHGVWTMEERGLAPKFDTTFESARPTQTHMALVQLERVGLLRFLVSQNVDGLHVRSG

FPRDKLAELHGNMFVEECAKCKTQYVRDTVVGTMGLKATGRLCTVAKARGLRACRGELRDTILDWEDS

LPDRDLALADEASRNADLSITLGTSLQIRPSGNLPLATKRRGGRLVIVNLQPTKHDRHADLRIHGYVD

EVMTRLMKHLGLEIPAWDGPRVLERALPPLEF

HMT effector domains:
NUE (*C. trachomatis*):

(SEQ ID NO: 97)
ASSPKKKRKVEASMTINSTQDTLYLSLHGGIDSAIPYPVRRVEQLLQFSFLPELQFQNAAVKQRIQRL

CYREEKRLAVSSLAKWLGQLHKQRLRAPKNPPVAICWINSYVGYGVFARESIPAWSYIGEYTGILRRR

QALWLDENDYCFRYPVPRYSFRYFTIDSGMQGNVTRFINHSDNPNLEAIGAFENGIFHIIIRAIKDIL

PGEELCYHYGPLYWKHRKKREEFVPQEEEF vSET (*P. bursaria chlorella virus*):

(SEQ ID NO: 98)
ASSPKKKRKVEASMFNDRVIVKKSPLGGYGVFARKSFEKGELVEECLCIVRHNDDWGTALEDYLFSRK

NMSAMALGFGAIFNHSKDPNARHELTAGLKRMRIFTIKPIAIGEEITISYGDDYWLSRPRLTQNEF

SUV39H1 (human):

(SEQ ID NO: 99)
ASSPKKKRKVEASNLKCVRILKQFHKDLERELLRRHHRSKTPRHLDPSLANYLVQKAKQRRALRRWEQ

ELNAKRSHLGRITVENEVDLDGPPRAFVYINEYRVGEGITLNQVAVGCECQDCLWAPTGGCCPGASLH

KFAYNDQGQVRLRAGLPIYECNSRCRCGYDCPNRVVQKGIRYDLCIFRTDDGRGWGVRTLEKIRKNSF

VMEYVGEIITSEEAERRGQIYDRQGATYLFDLDYVEDVYTVDAAYYGNISHFVNHSCDPNLQVYNVFI

DNLDERLPRIAFFATRTIRAGEELTFDYNMQVDPVDMESTRMDSNFGLAGLPGSPKKRVRIECKCGTE

SCRKYLFEF

DIM5 (*N. crassa*):

(SEQ ID NO: 100)
ASSPKKKRKVEASMEKAFRPHFFNHGKPDANPKEKKNCHWCQIRSFATHAQLPISIVNREDDAFLNPN

FRFIDHSIIGKNVPVADQSFRVGCSCASDEECMYSTCQCLDEMAPDSDEEADPYTRKKRFAYYSQGAK

KGLLRDRVLQSQEPIYECHQGCACSKDCPNRVVERGRTVPLQIFRTKDRGWGVKCPVNIKRGQFVDRY

LGEIITSEEADRRRAESTIARRKDVYLFALDKFSDPDSLDPLLAGQPLEVDGEYMSGPTRFINHSCDP

NMAIFARVGDHADKHIHDLALFAIKDIPKGTELTFDYVNGLTGLESDAHDPSKISEMTKCLCGTAKCR

GYLWEF

KYP (*A. thaliana*):

(SEQ ID NO: 101)
ASSPKKKRKVEASDISGGLEFKGIPATNRVDDSPVSPTSGFTYIKSLIIEPNVIIPKSSTGCNCRGSC

TDSKKCACAKLNGGNFPYVDLNDGRLIESRDVVFECGPHCGCGPKCVNRTSQKRLRFNLEVFRSAKKG

WAVRSWEYIPAGSPVCEYIGVVRRTADVDTISDNEYIFEIDCQQTMQGLGGRQRRLRDVAVPMNNGVS

QSSEDENAPEFCIDAGSTGNFARFINHSCEPNLFVQCVLSSHQDIRLARVVLFAADNISPMQELTYDY

GYALDSVHEF

SUVR4 (*A. thaliana*):

(SEQ ID NO: 102)
ASSPKKKRKVEASQSAYLHVSLARISDEDCCANCKGNCLSADFPCTCARETSGEYAYTKEGLLKEKFL

DTCLKMKKEPDSFPKVYCKDCPLERDHDKGTYGKCDGHLIRKFIKECWRKCGCDMQCGNRVVQRGIRC

QLQVYFTQEGKGWGLRTLQDLPKGTFICEYIGEILINTELYDRNVRSSSERHTYPVTLDADWGSEKDL

KDEEALCLDATICGNVARFINHRCEDANMIDIPIEIETPDRHYYHIAFFTLRDVKAMDELTWDYMIDF

NDKSHPVKAFRCCCGSESCRDRKIKGSQGKSIERRKIVSAKKQQGSKEVSKKRKEF

Set4 (*C. elegans*):

(SEQ ID NO: 103)
ASSPKKKRKVEASMQLHEQIANISVTFNDIPRSDHSMTPTELCYFDDFATTLVVDSVLNFTTHKMSKK

RRYLYQDEYRTARTVMKTFREQRDWTNAIYGLLTLRSVSHFLSKLPPNKLFEFRDHIVRFLNMFILDS

GYTIQECKRYSQEGHQGAKLVSTGVWSRGDKIERLSGVVCLLSSEDEDSILAQEGSDFSVMYSTRKRC

STLWLGPGAYINHDCRPTCEFVSHGSTAHIRVLRDMVPGDEITCFYGSEFFGPNNIDCECCTCEKNMN

GAFSYLRGNENAEPIISEKKTKYELRSRSEF

-continued

Set1 (C. elegans):
(SEQ ID NO: 104)
ASSPKKKRKVEASMKVAAKKLATSRMRKDRAAAASPSSDIENSENPSSLASHSSSSGRMTPSKNTRSR

KGVSVKDVSNHKITEFFQVRRSNRKTSKQISDEAKHALRDTVLKGTNERLLEVYKDVVKGRGIRTKVN

FEKGDFVVEYRGVMMEYSEAKVIEEQYSNDEEIGSYMYFFEHNNKKWCIDATKESPWKGRLINHSVLR

PNLKTKVVEIDGSHHLILVARRQIAQGEELLYDYGDRSAETIAKNPWLVNTEF

SETD8 (human):
(SEQ ID NO: 105)
ASSPKKKRKVEASSCDSTNAAIAKQALKKPIKGKQAPRKKAQGKTQQNRKLTDFYPVRRSSRKSKAEL

QSEERKRIDELIESGKEEGMKIDLIDGKGRGVIATKQFSRGDFVVEYHGDLIEITDAKKREALYAQDP

STGCYMYYFQYLSKTYCVDATRETNRLGRLINHSKCGNCQTKLHDIDGVPHLILIASRDIAAGEELLY

DYGDRSKASIEAFPWLKHEF

TgSET8 (T. gondii):
(SEQ ID NO: 106)
ASSPKKKRKVEASASRRTGEFLRDAQAPSRWLKRSKTGQDDGAFCLETWLAGAGDDAAGGERGRDREG

AADKAKQREERRQKELEERFEEMKVEFEEKAQRMIARRAALTGEIYSDGKGSKKPRVPSLPENDDDAL

IEIIIDPEQGILKWPLSVMSIRQRTVIYQECLRRDLTACIHLTKVPGKGRAVFAADTILKDDFVVEYK

GELCSEREAREREQRYNRSKVPMGSFMFYFKNGSRMMAIDATDEKQDFGPARLINHSRRNPNMTPRAI

TLGDFNSEPRLIFVARRNIEKGEELLVDYGERDPDVIKEHPWLNSEF

In some embodiments, ligand-dependent Cas9-intein variants are provided herein that exhibit decreased off-target activity. For example, in some embodiment, Cas9-intein variants are provided herein that comprise a Cas9 nuclease domain, or a nuclease-deficient Cas9 domain and a heterologous nucleic acid-editing domain, such as, for example, a heterologous nuclease domain, a recombinase domain, or a deaminase domain. In some such embodiments, the ligand-dependent Cas9-inteins provided herein exhibit decreased, minimal, or no off-target activity in the presence of a ligand at a concentration effective to effect excision of the intein from the Cas9-intein variant, or at a concentration effective to induce a desired modification (e.g., cleavage, nicking, recombination, or deamination) of a target site. In some embodiments, the ligand-dependent Cas9-intein variants provided herein exhibit an off-target activity in their active state (e.g., in the presence of or after being contacted with a suitable ligand) that is decreased as compared to the off-target activity of wild-type Cas9. For example, in some embodiments, the off-target activity of a Cas9-intein variant provided herein is decreased to less than 80%, less than 75%, less than 50%, less than 45%, less than 40%, less than 35%, less than 30%, less than 25%, less than 24%, less than 23%, less than 22%, less than 21%, less than 20, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, or less than 1% of wild-type Cas9 under the same conditions.

Pharmaceutical Compositions

In some embodiments, any of the ligand-dependent site-specific enzymes described herein are provided as part of a pharmaceutical composition. For example, some embodiments provide pharmaceutical compositions comprising a Cas9 protein comprising an intein, or fusion proteins comprising a dCas9 protein with an intein fused to a nuclease, recombinase, deaminase, or a transcriptional activator as provided herein, or a nucleic acid encoding such a protein, and a pharmaceutically acceptable excipient. Pharmaceutical compositions may further comprise one or more gRNA(s).

In some embodiments, compositions provided herein are administered to a subject, for example, to a human subject, in order to effect a targeted genomic modification within the subject. In some embodiments, cells are obtained from the subject and are contacted with an inventive ligand-dependent site-specific enzyme ex vivo. In some embodiments, cells removed from a subject and contacted ex vivo with an inventive ligand-dependent site-specific enzyme are re-introduced into the subject, optionally after the desired genomic modification has been effected and/or detected in the cells. Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's *The Science and Practice of Pharmacy*, 21$^{st}$ Edition, A. R. Gennaro (Lippincott, Williams & Wilkins, Baltimore, Md., 2006; incorporated in its entirety herein by reference) discloses various excipients used in formulating pharmaceutical compositions and known techniques for the preparation thereof. See also PCT application PCT/US2010/055131, incorporated in its entirety herein by reference, for additional suitable methods, reagents, excipients and solvents for producing pharmaceutical compositions comprising a nuclease. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

In some embodiments, compositions in accordance with the present invention may be used for treatment of any of a variety of diseases, disorders, and/or conditions, including, but not limited to, autoimmune disorders (e.g. diabetes, lupus, multiple sclerosis, psoriasis, rheumatoid arthritis); inflammatory disorders (e.g. arthritis, pelvic inflammatory disease); infectious diseases (e.g. viral infections (e.g., HIV, HCV, RSV), bacterial infections, fungal infections, sepsis); neurological disorders (e.g. Alzheimer's disease, Huntington's disease; autism; Duchenne muscular dystrophy); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); gastrointestinal disorders (e.g. inflammatory bowel disease, ulcers); musculoskeletal disorders (e.g. fibromyalgia, arthritis); endocrine, metabolic, and nutritional disorders (e.g. diabetes, osteoporosis); genitourinary disorders (e.g. renal disease); psychological disorders (e.g. depression, schizophrenia); skin disorders (e.g. wounds, eczema); and blood and lymphatic disorders (e.g. anemia, hemophilia); etc.

Methods

In another aspect of this disclosure, methods for site-specific nucleic acid (e.g., DNA) modification are provided. In some embodiments, the methods comprise contacting a DNA with any of the ligand-dependent Cas9 proteins (complexed with a gRNA) described herein, either before or after contacting the protein with a ligand that induces self-excision of the ligand-dependent intein thereby activating the nuclease. For example, in some embodiments, the method comprises (a) contacting a RNA-guided nuclease (e.g., a Cas9 protein including Cas9 nickase) comprising a ligand-dependent intein with a ligand, wherein binding of the ligand to the intein induces self-excision of the intein; and (b); contacting a DNA with the RNA-guided nuclease, wherein the RNA-guided nuclease is associated with a gRNA; whereby self-excision of the intein from the RNA-guided nuclease in step (a) allows the RNA-guided nuclease to cleave the DNA, thereby producing cleaved DNA. In some embodiments, for examples those involving the use of an intein containing Cas9 nickase, the method produces a single strand break in the DNA. In some embodiments, the method produces a double strand break in the DNA. In some embodiments, the RNA-guided nuclease is able to bind a gRNA and optionally bind a target nucleic acid prior to being contacted with a ligand that induces self-excision of the intein, but the RNA-guided nuclease is unable to cleave the target nucleic acid until self-excision of the intein occurs. In some embodiments, the RNA-guided nuclease is unable to bind a gRNA and therefore is unable to bind a target nucleic acid until the RNA-guided nuclease is contacted with a ligand that induces self-excision of the intein. In some embodiments, the RNA-guided nuclease is any nuclease comprising Cas9 (or a variant or a fragment thereof) which comprises a ligand-dependent intein as provided herein.

In some embodiments, the method involves the use of fusion proteins comprising a nuclease-inactivated Cas9 (e.g., dCas9) fused to a nuclease domain (e.g., FokI), wherein the fusion protein comprises a ligand-dependent intein (e.g., in the dCas9 domain as provided herein), and the fusion protein lacks one or more activities (as described herein) prior to excision of the intein. In some embodiments, the fusion protein is any fusion protein described herein. In some embodiments, the method comprises contacting a target nucleic acid (e.g., DNA) with two such fusion proteins, each comprising a distinct gRNA that targets the nucleic acid, and the method comprises contacting the target nucleic acid with two such fusion proteins. The method increases the specificity of cleavage, and therefore decreases off target effects, as two fusions are required to bind the target site to elicit any nuclease activity as the nuclease domains fused to the dCas9 domain typically must dimerize at the target site to induce cleavage. In some embodiments, the method comprises contacting the fusion proteins with a ligand that induces self-excision of the intein, either before or after the gRNAs bind the fusion proteins, and/or before or after the fusion proteins bind the target nucleic acid. Once the fusion proteins are activated following excision of the intein, the nuclease domains (e.g., the FokI domains) dimerize and cleave and the target nucleic acid. Compositions and methods of using dCas9-FokI fusions are known to those of skill in the art (see, e.g., U.S. patent application Ser. No. 14/320,498, titled "CAS9 VARIANTS AND USES THEREOF" which was filed on Jun. 30, 2014; the entire contents of which are incorporated herein by reference). Those of skill in the art are routinely able to design appropriate gRNAs that target two of the fusion proteins to a target nucleic acid, and understand that in some aspects the gRNAs are designed to hybridize to regions of the target nucleic acid that are no more than 10, no more than 15, no more than 20, no more than 25, no more than 30, no more than 40, no more than 50, no more than 60, no more than 70, no more than 80, no more than 90, or no more than 100 base pairs apart.

In some embodiments, any of the methods provided herein can be performed on DNA in a cell. For example, in some embodiments the DNA contacted by any of the inventive ligand-dependent site-specific Cas9 enzymes provided herein is in a eukaryotic cell. In some embodiments, the eukaryotic cell is in an individual. In some embodiments, the individual is a human. In some embodiments, any of the methods provided herein are performed in vitro. In some embodiments, any of the methods provided herein are performed in vivo.

In some embodiments of this disclosure, methods for site-specific nucleic acid (e.g., DNA) recombination are provided. In some embodiments, the methods are useful for inducing recombination of or between two or more regions of two or more nucleic acids (e.g., DNA). In some embodiments, the methods are useful for inducing recombination of or between two or more regions in a single nucleic acid molecule (e.g., DNA). Because the recombinase fusion proteins used in the methods are ligand-dependent, the timing of recombination can be controlled to minimize off-target effects. In some embodiments, the recombination of one or more target nucleic acid molecules requires the formation of a tetrameric complex at the target site. Typically, the tetramer comprises four (4) inventive RNA-guided recombinase fusion proteins (e.g., a complex of any four inventive recombinase fusion proteins provided herein). In some embodiments, each recombinase fusion protein of the tetramer targets a particular DNA sequence via a distinct gRNA bound to each recombinase fusion protein. In some embodiments, the fusion proteins are first contacted with a ligand that induces self-excision of the intein, thereby allowing the fusion proteins to (i) bind a gRNA, (ii) bind a target nucleic acid(s), and (iii) form a complex to induce recombination between the target nucleic acid(s). In some embodiments, the fusion proteins are able to bind a gRNA prior to excision of the intein and optionally are able to bind the target nucleic acid(s) but are unable to induce recombination until the intein is excised (e.g., through the addition of a ligand that binds the ligand-dependent intein). Any of the ligand-dependent recombinase fusion proteins provided herein are useful for methods for site-specific recombination.

In some embodiments, the method for site-specific recombination between two DNA molecules comprises (a) contacting a first DNA with a first ligand-dependent RNA-guided recombinase fusion protein, wherein the nuclease-inactivated Cas9 domain binds a first gRNA that hybridizes to a region of the first DNA; (b) contacting the first DNA with a second ligand-dependent RNA-guided recombinase fusion protein, wherein the nuclease-inactivated Cas9 domain of the second fusion protein binds a second gRNA that hybridizes to a second region of the first DNA; (c) contacting a second DNA with a third ligand-dependent RNA-guided recombinase fusion protein, wherein the nuclease-inactivated Cas9 domain of the third fusion protein binds a third gRNA that hybridizes to a region of the second DNA; and (d) contacting the second DNA with a fourth ligand-dependent RNA-guided recombinase fusion protein, wherein the nuclease-inactivated Cas9 domain of the fourth fusion protein binds a fourth gRNA that hybridizes to a second region of the second DNA. In some embodiments, the fusion proteins are first contacted with a ligand that induces self-excision of the intein prior to forming a complex with a gRNA and/or prior to hybridizing with a target DNA. In some embodiments, the method comprises contacting the fusion proteins with the ligand after the fusion proteins form a complex and/or hybridizes to a target DNA. Typically, the binding of the fusion proteins in steps (a)-(d) results in the tetramerization of the recombinase catalytic domains of the fusion proteins, such that the DNAs are recombined (i.e., following excision of the intein). In some embodiments, the gRNAs of steps (a) and (b) hybridize to opposing strands of the first DNA, and the gRNAs of steps (c) and (d) hybridize to opposing strands of the second DNA. In some embodiments, the target sites of the gRNAs of steps (a)-(d) are spaced to allow for tetramerization of the recombinase catalytic domains. For example, in some embodiments, the target sites of the gRNAs of steps (a)-(d) are no more than 10, no more 15, no more than 20, no more than 25, no more than 30, no more than 40, no more than 50, no more than 60, no more than 70, no more than 80, no more than 90, or no more than 100 base pairs apart. In some embodiments, the two regions of the two DNA molecules being recombined share homology, such that the regions being recombined are at least 80%, at least 90%, at least 95%, at least 98%, or are 100% homologous.

In some embodiments, methods for site-specific recombination between two regions of a single DNA molecule are provided. In some embodiments, the methods comprise (a) contacting a DNA with a first dCas9-recombinase fusion protein, wherein the dCas9 domain binds a first gRNA that hybridizes to a region of the DNA; (b) contacting the DNA with a second dCas9-recombinase fusion protein, wherein the dCas9 domain of the second fusion protein binds a second gRNA that hybridizes to a second region of the DNA; (c) contacting the DNA with a third dCas9-recombinase fusion protein, wherein the dCas9 domain of the third fusion protein binds a third gRNA that hybridizes to a third region of the DNA; and (d) contacting the DNA with a fourth dCas9-recombinase fusion protein, wherein the dCas9 domain of the fourth fusion protein binds a fourth gRNA that hybridizes to a fourth region of the DNA. In some embodiments, the fusion proteins are first contacted with a ligand that induces self-excision of the intein prior to forming a complex with a gRNA and/or prior to hybridizing with a target DNA. In some embodiments, the method comprises contacting the fusion proteins with the ligand after the fusion proteins form a complex and/or hybridizes to a target DNA. Typically, the binding of the fusion proteins in steps (a)-(d) results in the tetramerization of the recombinase catalytic domains of the fusion proteins, such that the DNA is recombined (e.g. following the excision of the intein). In some embodiments, two of the gRNAs of steps (a)-(d) hybridize to the same strand of the DNA, and the other two gRNAs of steps (a)-(d) hybridize to the opposing strand of the DNA. In some embodiments, the gRNAs of steps (a) and (b) hybridize to regions of the DNA that are no more 10, no more than 15, no more than 20, no more than 25, no more than 30, no more than 40, no more than 50, no more than 60, no more than 70, no more than 80, no more than 90, or no more than 100 base pairs apart, and the gRNAs of steps (c) and (d) hybridize to regions of the DNA that are no more than 10, no more 15, no more than 20, no more than 25, no more than 30, no more than 40, no more than 50, no more than 60, no more than 70, no more than 80, no more than 90, or no more than 100 base pairs apart. In some embodiments, the two regions of the DNA molecule being recombined share homology, such that the regions being recombined are at least 80%, at least 90%, at least 95%, at least 98%, or are 100% homologous.

In some embodiments, any of the inventive methods for site-specific recombination are amenable for inducing recombination, such that the recombination results in excision (e.g., a segment of DNA is excised from a target DNA molecule), insertion (e.g., a segment of DNA is inserted into a target DNA molecule), inversion (e.g., a segment of DNA is inverted in a target DNA molecule), or translocation (e.g., the exchange of DNA segments between one or more target DNA molecule(s)). In some embodiments, the particular recombination event (e.g., excision, insertion, inversion, translocation, etc.) depends, inter alia, on the orientation (e.g., with respect to the target DNA molecule(s)) of the bound RNA-guided recombinase fusion protein(s). In some embodiments, the orientation, or direction, in which a RNA-guided recombinase fusion protein binds a target nucleic acid can be controlled, e.g., by the particular sequence of the gRNA bound to the RNA-guided recombinase fusion protein(s). Methods for controlling or directing a particular recombination event are known in the art, and include, for example, those described by Turan and Bode, "Site-specific recombinases: from tag-and-target-to tag-and-exchange-based genomic modifications." *FASEB J.* 2011; December; 25(12):4088-107, the entire contents of which are hereby incorporated by reference.

In some embodiments, any of the methods for site-specific recombination can be performed in vivo or in vitro. In some embodiments, any of the methods for site-specific recombination are performed in a cell (e.g., recombining genomic DNA in a cell). The cell can be prokaryotic or eukaryotic. The cell, such as a eukaryotic cell, can be in an individual, such as a subject, as described herein (e.g., a human subject). The methods described herein are useful for the genetic modification of cells in vitro and in vivo, for example, in the context of the generation of transgenic cells, cell lines, or animals, or in the alteration of genomic sequence, e.g., the correction of a genetic defect, in a cell in or obtained from a subject. In some embodiments, a cell obtained from a subject and modified according to the methods provided herein, is re-introduced into a subject (e.g., the same subject), e.g., to treat a disease, or for the production of genetically modified organisms in agricultural, medical, or biological research.

In applications in which it is desirable to recombine two or more nucleic acids so as to insert a nucleic acid sequence into a target nucleic acid, a nucleic acid comprising a donor sequence to be inserted is also provided, e.g., to a cell. By a "donor sequence" it is meant a nucleic acid sequence to be inserted at the target site induced by one or more RNA-guided recombinase fusion protein(s). In some embodiments, e.g., in the context of genomic modifications, the donor sequence will share homology to a genomic sequence at the target site, e.g., 1%, 2%, 3%, 4%, 5%, 10%, 20%, 30%, 40%, 50%, 60%, 70%, 80%, 85%, 90%, 95%, or 100% homology with the nucleotide sequences flanking the target site, e.g., within about 100 bases or less of the target site, e.g. within about 90 bases, within about 80 bases, within about 70 bases, within about 60 bases, within about 50 bases, within about 40 bases, within about 30 bases, within about 15 bases, within about 10 bases, within about 5 bases, or immediately flanking the target site. In some embodiments, the donor sequence does not share any homology with the target nucleic acid, e.g., does not share homology to a genomic sequence at the target site. Donor sequences can be of any length, e.g., 10 nucleotides or more, 50 nucleotides or more, 100 nucleotides or more, 250 nucleotides or more, 500 nucleotides or more, 1000 nucleotides or more, 5000 nucleotides or more, 10000 nucleotides or more, 100000 nucleotides or more, etc.

Typically, the donor sequence is not identical to the target sequence that it replaces or is inserted into. In some embodiments, the donor sequence contains at least one or more single base changes, insertions, deletions, inversions, or rearrangements with respect to the target sequence (e.g., target genomic sequence). In some embodiments, donor sequences also comprise a vector backbone containing sequences that are not homologous to the DNA region of interest and that are not intended for insertion into the DNA region of interest.

The donor sequence may comprise certain sequence differences as compared to the target (e.g., genomic) sequence, for example, restriction sites, nucleotide polymorphisms, selectable markers (e.g., drug resistance genes, fluorescent proteins, enzymes etc.), which can be used to assess successful insertion of the donor sequence at the target site or in some cases may be used for other purposes (e.g., to signify expression at the targeted genomic locus). In some embodiments, if located in a coding region, such nucleotide sequence differences will not change the amino acid sequence, or will make silent amino acid changes (e.g., changes which do not affect the structure or function of the protein). In some embodiments, these sequences differences may include flanking recombination sequences such as FLPs, loxP sequences, or the like, that can be activated at a later time for removal of e.g., a marker sequence. The donor sequence may be provided to the cell as single-stranded DNA, single-stranded RNA, double-stranded DNA, or double-stranded RNA. It may be introduced into a cell in linear or circular form. If introduced in linear form, the ends of the donor sequence may be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, e.g., Chang et al., *Proc. Natl. Acad Sci USA*. 1987; 84:4959-4963; Nehls et al., *Science*. 1996; 272:886-889. In some embodiments, a donor sequence is introduced into a cell as part of a vector molecule having additional sequences such as, for example, replication origins, promoters, and genes encoding antibiotic resistance. In some embodiments, donor sequences can be introduced as naked nucleic acid, as nucleic acid complexed with an agent such as a liposome or polymer (e.g., poloxamer), or can be delivered by viruses (e.g., adenovirus, AAV, etc.).

In some embodiments, any of the methods provided herein can be performed on DNA in a cell. For example, in some embodiments the DNA contacted by any RNA/gRNA-comprising complex provided herein is in a eukaryotic cell. In some embodiments, the eukaryotic cell is in an individual. In some embodiments, the individual is a human. In some embodiments, any of the methods provided herein are performed in vitro. In some embodiments, any of the methods provided herein are performed in vivo.

In some embodiments of this disclosure, methods for site-specific nucleic acid (e.g., DNA) editing are provided. In some embodiments, the fusion protein is used to introduce a point mutation into a nucleic acid by deaminating a target nucleobase, e.g., a cytidine (C) residue. In some embodiments, the method comprises contacting a DNA molecule with a ligand-dependent fusion protein comprising a nuclease inactivated RNA-guided nuclease (e.g., dCas9), which comprises a ligand dependent intein, fused to a deaminase, and (b) a gRNA targeting the fusion protein of step (a) to a target nucleotide sequence of the DNA strand; wherein the DNA molecule is contacted with the fusion protein and the gRNA in an amount effective and under conditions suitable for the deamination of a nucleotide base. Any of the fusion proteins comprising a gene editing domain as provided herein are amenable for use in the methods. In some embodiments, the method first comprises contacting the fusion protein with a ligand that induces self-excision of the intein prior to forming a complex with the gRNA. In some embodiments, the method comprises contacting the fusion protein with a ligand that induces self-excision of the intein after the fusion protein has formed a complex with the gRNA.

In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. Compositions and methods of using gene editing enzymes fused e.g., to Cas9 are known, and include those described in U.S. patent application Ser. No. 14/325,815 titled "FUSIONS OF CAS9 DOMAINS AND NUCLEIC ACID-EDITING DOMAINS," and filed on Jul. 8, 2014; the entire contents of which are incorporated herein by reference. The fusion proteins provided herein (comprising ligand-dependent inteins) can be validated for gene editing-based human therapeutics in vitro, e.g., by correcting a disease-associated mutation in human cell culture. It will be understood by the skilled artisan that the fusion proteins provided herein, e.g., the fusion proteins comprising a dCas9 domain (e.g., comprising a ligand-dependent intein) and a nucleic acid deaminase domain can be used to correct any single point T→C or A→G mutation. In the first case, deamination of the mutant C back to U corrects the mutation, and in the latter case, deamination of the C that is base-paired with the mutant G, followed by a round of replication, corrects the mutation.

An exemplary disease-relevant mutation that can be corrected by the provided fusion proteins in vitro or in vivo is the H1047R (A3140G) polymorphism in the PI3KCA protein. The phosphoinositide-3-kinase, catalytic alpha subunit (PI3KCA) protein acts to phosphorylate the 3-OH group of the inositol ring of phosphatidylinositol. The PI3KCA gene has been found to be mutated in many different carcinomas, and thus it is considered to be a potent oncogene (Lee et al., PIK3CA gene is frequently mutated in breast carcinomas and hepatocellular carcinomas. *Oncogene*. 2005; 24(8): 1477-80). In fact, the A3140G mutation is present in several NCI-60 cancer cell lines, such as, for example, the HCT116, SKOV3, and T47D cell lines, which are readily available from the American Type Culture Collection (ATCC)(Ikediobi et al., Mutation analysis of 24 known cancer genes in the NCI-60 cell line set. *Mol Cancer Ther.* 2006; 5(11): 2606-12.

In some embodiments, a cell carrying a mutation to be corrected, e.g., a cell carrying a point mutation, e.g., an A3140G point mutation in exon 20 of the PI3KCA gene, resulting in a H1047R substitution in the PI3KCA protein is contacted with an expression construct encoding a ligand-dependent Cas9 deaminase fusion protein and an appropriately designed gRNA targeting the fusion protein to the respective mutation site in the encoding PI3KCA gene. Control experiments can be performed where the gRNAs are designed to target the fusion enzymes to non-C residues that are within the PI3KCA gene. Genomic DNA of the treated cells can be extracted, and the relevant sequence of the PI3KCA genes PCR amplified and sequenced to assess the activities of the fusion proteins in human cell culture.

It will be understood that the example of correcting point mutations in PI3KCA is provided for illustration purposes and is not meant to limit the instant disclosure. The skilled artisan will understand that the instantly disclosed ligand-dependent DNA-editing fusion proteins can be used to correct other point mutations and mutations associated with other cancers and with diseases other than cancer including other proliferative diseases.

The successful correction of point mutations in disease-associated genes and alleles opens up new strategies for gene correction with applications in therapeutics and basic research. Site-specific single-base modification systems like the disclosed fusions of ligand-dependent Cas9 and deaminase enzymes or domains also have applications in "reverse" gene therapy, where certain gene functions are purposely suppressed or abolished. In these cases, site-specifically mutating Trp (TGG), Gln (CAA and CAG), or Arg (CGA) residues to premature stop codons (TAA, TAG, TGA) can be used to abolish protein function in vitro, ex vivo, or in vivo.

The instant disclosure provides methods for the treatment of a subject diagnosed with a disease associated with or caused by a point mutation that can be corrected by a ligand-dependent Cas9 DNA editing fusion protein provided herein. For example, in some embodiments, a method is provided that comprises administering to a subject having such a disease, e.g., a cancer associated with a PI3KCA point mutation as described above, an effective amount of a ligand-dependent Cas9 deaminase fusion protein that corrects the point mutation or introduces a deactivating mutation into the disease-associated gene, e.g., following subsequent administration of the small molecule (e.g., ligand) that activates the fusion protein. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders include, without limitation, cystic fibrosis (see, e.g., Schwank et al., Functional repair of CFTR by CRISPR/Cas9 in intestinal stem cell organoids of cystic fibrosis patients. *Cell stem cell*. 2013; 13: 653-658; and Wu et. al., Correction of a genetic disease in mouse via use of CRISPR-Cas9. *Cell stem cell*. 2013; 13: 659-662, neither of which uses a deaminase fusion protein to correct the genetic defect); phenylketonuria—e.g., phenylalanine to serine mutation at position 835 in phenylalanine hydroxylase gene (T>C mutation)—see, e.g., McDonald et al., *Genomics*. 1997; 39:402-405; Bernard-Soulier syndrome (BSS)—e.g., phenylalanine to serine mutation at position 55 in the platelet membrane glycoprotein IX (T>C mutation)—see, e.g., Noris et al., *British Journal of Haematology*. 1997; 97: 312-320; epidermolytic hyperkeratosis (EHK)—e.g., leucine to proline mutation at position 160 in keratin 1 (T>C mutation)—see, e.g., Chipev et al., *Cell*. 1992; 70: 821-828; chronic obstructive pulmonary disease (COPD)—e.g., leucine to proline mutation at position 55 in 1-antitrypsin (T>C mutation)—see, e.g., Poller et al., *Genomics*. 1993; 17: 740-743; Charcot-Marie-Toot disease type 4J—e.g., leucine to proline mutation at position 197 in FIG. 4 (T>C mutation)—see, e.g., Kundu et al., 3 *Biotech*. 2013; 3: 225-234;

neuroblastoma (NB)—e.g., isoleucine to threonine mutation at position 41 in Caspase-9 (T>C mutation)—see, e.g., Lenk et al., *PLoS Genetics.* 2011; 7: e1002104; von Willebrand disease (vWD)—e.g., cysteine to arginine mutation at position 509 in von Willebrand factor (T>C mutation)—see, e.g., Lavergne et al., *Br. J. Haematol.* 1992; 82: 66-72; myotonia congenital—e.g., cysteine to arginine mutation at position 277 in the muscle chloride channel gene CLCN1 (T>C mutation)—see, e.g., Weinberger et al., *The J. of Physiology.* 2012; 590: 3449-3464; hereditary renal amyloidosis—e.g., stop codon to arginine mutation at position 78 in apolipoprotein AII (T>C mutation)—see, e.g., Yazaki et al., *Kidney Int.* 2003; 64: 11-16; dilated cardiomyopathy (DCM)—e.g., tryptophan to Arginine mutation at position 148 in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 in tyrosine kinase (A>G mutation), see, e.g., Irrthum et al., *Am. J. Hum. Genet.* 2000; 67: 295-301; familial Alzheimer's disease—e.g., isoleucine to valine mutation at position 143 in presenilin1 (A>G mutation), see, e.g., Gallo et. al., *J. Alzheimer's disease.* 2011; 25: 425-431; Prion disease—e.g., methionine to valine mutation at position 129 in prion protein (A>G mutation)—see, e.g., Lewis et. al., *J. of General Virology.* 2006; 87: 2443-2449; chronic infantile neurologic cutaneous articular syndrome (CINCA)—e.g., Tyrosine to Cysteine mutation at position 570 in cryopyrin (A>G mutation)—see, e.g., Fujisawa et. al. *Blood.* 2007; 109: 2903-2911; and desmin-related myopathy (DRM)—e.g., arginine to glycine mutation at position 120 in B crystallin (A>G mutation)—see, e.g., Kumar et al., *J. Biol. Chem.* 1999; 274: 24137-24141. The entire contents of each of the foregoing references and database entries are incorporated herein by reference.

According to another aspect, methods for transcriptional activation of a gene are provided. In some embodiments, the methods comprise contacting a DNA molecule comprising a gene with (a) a ligand-dependent dCas9 fusion protein comprising a transcriptional activator (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the transcriptional activation of the gene. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene. Methods for inducing gene activation using fusion proteins comprising a transcriptional activator are known in the art, and include those described by Perex-Pinera et al., "RNA-guided gene activation by CRISPR-Cas9-based transcription factors." *Nature Methods.* 2013; 10, 973-976; the entire contents of which are incorporated herein by reference.

According to another aspect, methods for transcriptional repression of a gene are provided. In some embodiments, the methods comprise contacting a DNA molecule comprising a gene with (a) a ligand-dependent dCas9 fusion protein comprising a transcriptional repressor (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the transcriptional repression of the gene. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene. Methods for inducing gene repression using fusion proteins comprising a transcriptional repressor are known in the art, and include those described by Gilbert et al., CRISPR-mediated modular RNA-guided regulation of transcription in eukaryotes. *Cell.* 2013; 154, 442-451; the entire contents of which are incorporated herein by reference.

According to another aspect, methods for epigenetic modification of DNA are provided. In some embodiments, the methods comprise contacting a DNA molecule comprising with (a) a ligand-dependent dCas9 fusion protein comprising an epigenetic modifier (e.g., any of those provided herein) and (b) a gRNA targeting the fusion protein of (a) to a target nucleotide sequence of the DNA strand; wherein the DNA molecule is contacted with the fusion protein and the gRNA in an amount effective and under conditions suitable for the epigenetic modification of the DNA. In some embodiments, the DNA comprises one or more genes. In some embodiments, the method further comprises contacting the fusion protein with a ligand that induces self-excision of the intein. In some embodiments, the fusion protein is contacted with the ligand prior to forming a complex with a gRNA. In some embodiments, the fusion protein is contacted with the ligand after forming a complex with a gRNA. In some embodiments, the gRNA targets the promoter region of a gene. In some embodiments, the epigenetic modification that results is methylation od DNA. In some embodiments, the epigenetic modification that results is demethylation of DNA. In some embodiments, the epigenetic modification that results is methylation of histone protein. In some embodiments, the epigenetic modification that results is demethylation of histone protein. In some embodiments, the epigenetic modification that results is acetylation of histone protein. In some embodiments, the epigenetic modification that results is deacetylation of histone protein. Methods for inducing epigenetic modifications using fusion proteins comprising an epigenetic modifier are known in the art, and include those described by Konermann et al., Optical control of mammalian endogenous transcription and epigenetic states. *Nature.* 2013; 500, 472-476; Mendenhall et al., Locus-specific editing of histone modifications at endogenous enhancers. *Nat. Biotechnol.* 2013; 31, 1133-1136; and Maeder et al., Targeted DNA demethylation and activation of endogenous genes using programmable TALE-TET1 fusion proteins. *Nat. Biotechnol.* 2013; 31, 1137-1142; the entire contents of which are incorporated herein by reference.

In some embodiments, any of the methods provided herein can be performed on DNA in a cell. For example, in some embodiments the DNA contacted by any RNA/gRNA-comprising complex provided herein is in a eukaryotic cell. In some embodiments, the eukaryotic cell is in an individual. In some embodiments, the individual is a human. In some embodiments, any of the methods provided herein are performed in vitro. In some embodiments, any of the methods provided herein are performed in vivo.

In some embodiments of the methods provided herein, the ligand-dependent Cas9 protein, e.g., the Cas9-intein or the Cas9-intein fusion protein, is contacted with the ligand at a concentration effective to excise the intein from the Cas9-intein variant, or at a concentration effective to induce a desired modification (e.g., cleavage, nicking, recombination, or deamination) of a target site. In some embodiments, a ligand-dependent Cas9 protein provided herein is contacted with a suitable ligand at a concentration resulting in decreased off-target activity of the Cas9 protein as compared to the off-target activity of wild-type Cas9. For example, in some embodiments, a method provided herein comprises contacting a population of ligand-dependent Cas9 proteins in vitro or in vivo in the presence of a target nucleic acid to be modified with a suitable ligand at a concentration resulting in the desired modification of the target nucleic acid, and in either no off-target activity (i.e., no modification of any non-target nucleic acids) or in an off-target activity of less than 80%, less than 75%, less than 50%, less than 45%, less than 40%, less than 35%, less than 30%, less than 25%, less than 24%, less than 23%, less than 22%, less than 21%, less than 20, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, or less than 1% of the off-target activity observed or expected under the same conditions when using wild-type Cas9.

Polynucleotides, Vectors, Cells, Kits

In another aspect of this disclosure, polynucleotides encoding one or more of the inventive proteins and/or gRNAs are provided. For example, polynucleotides encoding any of the proteins described herein are provided, e.g., for recombinant expression and purification of isolated nucleases, recombinases, gene editing enzymes, and other nucleic acid modifying enzymes, e.g., comprising Cas9 variants (e.g., dCas9) comprising ligand-dependent inteins. In some embodiments, an isolated polynucleotide comprises one or more sequences encoding a ligand dependent RNA-guided nuclease (e.g., Cas9). In some embodiments, an isolated polynucleotide comprises one or more sequences encoding a Cas9 fusion protein, for example, any of the Cas9 fusion proteins described herein (e.g., those comprising a nuclease-inactivated Cas9 fused to a nuclease, recombinase, deaminase domain, or transcriptional activator). In some embodiments, an isolated polynucleotides comprises one or more sequences encoding a gRNA, alone or in combination with a sequence encoding any of the proteins described herein.

In some embodiments, vectors encoding any of the proteins described herein are provided, e.g., for recombinant expression and purification of Cas9 proteins, and/or fusions comprising Cas9 proteins (e.g., variants). In some embodiments, the vector comprises or is engineered to include an isolated polynucleotide, e.g., those described herein. In some embodiments, the vector comprises one or more sequences encoding a Cas9 protein (as described herein), a gRNA, or combinations thereof, as described herein. Typically, the vector comprises a sequence encoding an inventive protein operably linked to a promoter, such that the fusion protein is expressed in a host cell.

In some embodiments, cells are provided, e.g., for recombinant expression and purification of any of the Cas9 proteins provided herein. The cells include any cell suitable for recombinant protein expression, for example, cells comprising a genetic construct expressing or capable of expressing an inventive protein (e.g., cells that have been transformed with one or more vectors described herein, or cells having genomic modifications, for example, those that express a protein provided herein from an allele that has been incorporated into the cell's genome). Methods for transforming cells, genetically modifying cells, and expressing genes and proteins in such cells are well known in the art, and include those provided by, for example, Green and Sambrook, *Molecular Cloning: A Laboratory Manual* (4$^{th}$ ed., Cold Spring Harbor Laboratory Press, Cold Spring Harbor, N.Y. (2012)) and Friedman and Rossi, *Gene Transfer: Delivery and Expression of DNA and RNA, A Laboratory Manual* (1$^{st}$ ed., Cold Spring Harbor Laboratory Press, Cold Spring Harbor, N.Y. (2006)).

Some aspects of this disclosure provide kits comprising a ligand-dependent Cas9 variant (e.g., a ligand dependent Cas9 nuclease (or nickase), and/or a ligand-dependent dCas9 variant fused to a nuclease, recombinase, deaminase, or a transcriptional activator as provided herein. In some embodiments, the kit comprises a polynucleotide encoding an inventive Cas9 variant, nuclease, recombinase, and/or deaminase e.g., as provided herein. In some embodiments, the kit comprises a vector for recombinant protein expression, wherein the vector comprises a polynucleotide encoding any of the proteins provided herein. In some embodiments, the kit comprises a cell (e.g., any cell suitable for expressing Cas9 proteins or fusions comprising Cas9 proteins, such as bacterial, yeast, or mammalian cells) that comprises a genetic construct for expressing any of the proteins provided herein. In some embodiments, any of the kits provided herein further comprise one or more gRNAs and/or vectors for expressing one or more gRNAs. In some embodiments, the kit comprises an excipient and instructions for contacting the Cas9 proteins or dCas9 fusions with the excipient to generate a composition suitable for contacting a nucleic acid with the inventive protein. In some embodiments, the composition is suitable for delivering an inventive protein to a cell, or for delivering a nucleic acid encoding the protein to a cell. In some embodiments, the composition is suitable for delivering an inventive protein to a subject. In some embodiments, the excipient is a pharmaceutically acceptable excipient.

EXAMPLES

Example 1: Small Molecule-Controlled Cas9

Cas9 variants that can be activated in the presence of a small molecule were engineered, allowing spatiotemporal control over DNA cleavage. These engineered Cas9 variants contain a small-molecule-regulated intein (Buskirk et al., Proc. Natl. Acad. Sci. USA. 2004; 101, 10505-10510), which has been optimized for mammalian cells (Peck et al., *Chem. Biol.* 2011; 18 (5), 619-630), that renders the protein inactive as a nuclease. Upon addition of the cell-permeable molecule, 4-hydroxytamoxifen (4-HT), the intein excises itself from the protein and ligates the flanking extein sequences, restoring Cas9 activity. Because these Cas9 variants can be active over a smaller time window than wild-type Cas9, the likelihood of having off-target cleavage is reduced.

The 37R3-2 intein was inserted at 15 different positions into human codon-optimized *Streptococcus pyogenes* Cas9 (e.g., SEQ ID NO:2). The intein was inserted in place of a single cysteine, alanine, serine, or threonine residue. Upon excision, the intein leaves a cysteine residue. Thus, the primary structure generated following protein splicing is either identical to the unmodified version of Cas9 when the intein is inserted in place of cysteine, or it is one amino acid different when the intein is inserted in place of alanine, serine, or threonine.

Plasmid constructs were generated in which the intein replaced amino acid residues: Cys80, Ala127, Thr146, Ser219, Thr333, Thr519, Cys574, Thr622, Ser701, Ala728, Thr995, Ser1006, Ser1154, Ser1159, or Ser1274 (e.g., in the amino acid sequence set forth as SEQ ID NO:2). These plasmids express the Cas9 variant with a nuclear localization signal (NLS) and 3×FLAG tag from the CMV promoter.

HEK293-GFP stable cells were transfected with the Cas9 expression plasmid, a gRNA (targeting Emerald GFP; Guilinger et al., *Nature Biotechnology* (2014)), and iRFP670 (transfection control), using Lipofectamine 2000. Twelve hours after transfection, media, either containing 4-HT (1 µM) or without 4-HT, was added.

Five days after transfection, cells were trypsinized and analyzed on a flow cytometer. Cells lacking GFP indicated genome modification. Cas9 variants that induced minimal genome modification in the absence of 4-HT but induce significant genome modification in the presence of 4-HT were deemed small-molecule-regulated variants in this Example. Of fifteen targeted insertions, five demonstrated minimal genome modification in the absence of 4-HT. These variants are highlighted in bold in the Table I below.

Additionally, a time course was performed in which incubation with 4-HT was limited to 2, 4, 8, 12 or 24 hours, after which point the media was replaced. Presumably, the shorter time an "active" cas9 is present, the less off-target cleavage. As depicted in Table II below, treating with 4-HT for 2 hours is sufficient for on-target cleavage and longer treatment periods do not show significant increased cleavage in this assay.

To assess the ability of the ligand-dependent Cas9 proteins to affect genomic modifications in the presence of absence of ligand, HEK293-GFP stable cells (GenTarget) were transfected with Cas9 expression plasmids and sgRNAs targeting EMX, VEGF, or CLTA genomic sites using Lipofectamine 2000 as previously described (Guilinger et al., Fusion of catalytically inactive Cas9 to FokI nuclease improves the specificity of genome modification *Nature Biotechnology*. 2014; 32(6):577-82). 4-HT (1 µM) was added during transfection for +4-HT samples. 12 hours after transfection the media was replaced. 60 hours after transfection, cells were trypsinized and genomic DNA was isolated using the DNAdvance kit (Agencourt). 40-80 ng of genomic DNA was used as a template to PCR amplify the targeted genomic loci with flanking Survey primer pairs as previously described (Guilinger et al., Fusion of catalytically inactive Cas9 to FokI nuclease improves the specificity of genome modification *Nature Biotechnology*. 2014; 32(6):577-82). PCR products were purified with a QIAquick PCR Purification Kit (Qiagen) and quantified with a Quant-iT PicoGreen dsDNA Kit (Life Technologies). 200 ng of purified PCR DNA was then combined with 2 µL of NEBuffer 2 (NEB) in a total volume of 19 µL and denatured then re-annealed with thermocycling at 95° C. for 5 min, 95-85° C. at 2° C./s, 85-20° C. at 0.2° C./s. The re-annealed DNA was incubated with 1 µL of T7 Endonuclease I (10 U/µL, NEB) at 37° C. for 15 min. 10 µL of 50% glycerol was added to the T7 Endonuclease reaction and 15 µL was analyzed on a 5% TBE 18-well Criterion PAGE gel (Bio-Rad) electrophoresed for 30 min at 200V and stained with EtBr for 15 min.

Figure 2:
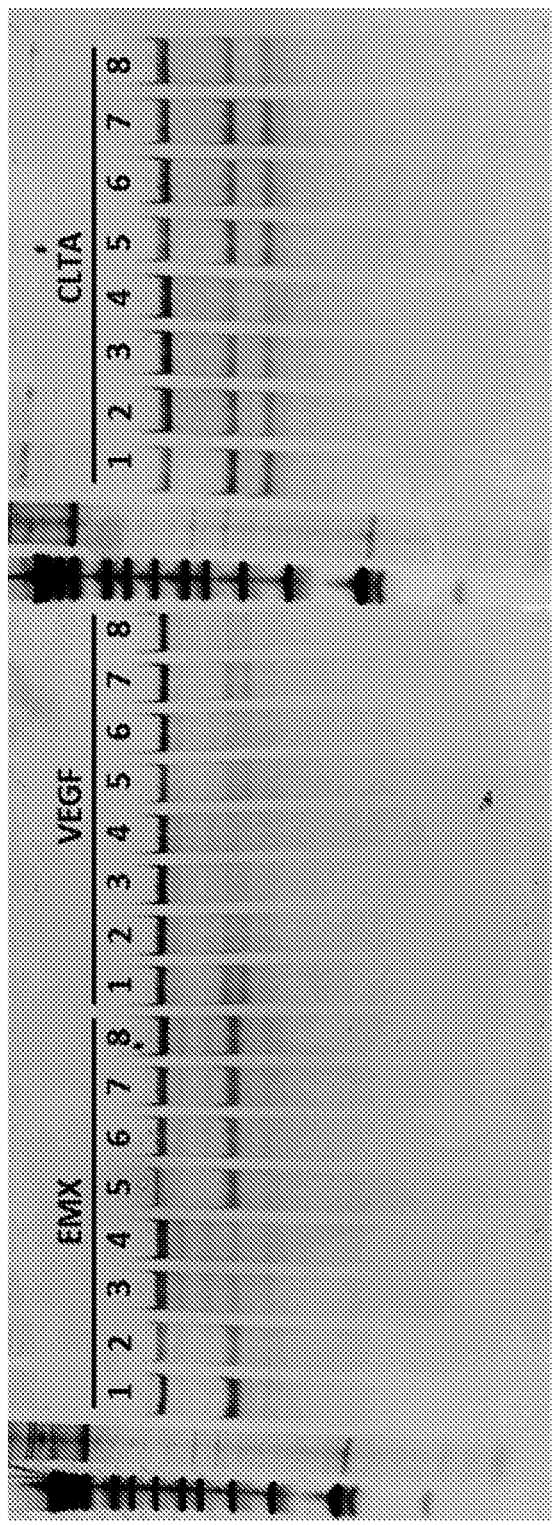
FIG. 2 shows the results of T7 Endonuclease I Surveyor assay used to assess ligand-dependent Cas9 gene modification at three target sites (EMX, VEGF, or CLTA). The presence of two bands corresponding to smaller DNA fragments (the fragments are approximately the same size for EMX) indicates genomic modification.

As shown in FIG. 2, the addition of 4-HT to ligand-dependent Cas9:Intein variants (Cas9:Intein with 37R3-2 replacing S219 (SEQ ID NO:30) and Cas9:Intein with 37R3-2 replacing C574 (SEQ ID NO:33)) resulted in genomic modification of the target sites, comparable to modification by wild-type Cas9. In the absence of 4-HT, the Cas9:Intein variants displayed minimal or no modification of the EMX and VEGF genomic target sites, while some background cleavage was observed for the CLTA genomic target site. Gene modification levels can be estimated by comparing the intensities of the cleaved (two smaller fragments) and uncleaved bands. These results demonstrate that Cas9 cleavage of genomic target sites can be controlled by the addition of ligand (here, 4-HT) which activates the proteins.

TABLE 1

| | Cells without GFP (%) | |
|---|---|---|
| Cas9 Variant | −4-HT | +4-HT |
| None | 4.65 | 3.42 |
| wild-type cas9 | 48.49 | 40.49 |
| intein(Cys80)-Cas9 (SEQ ID NO:27) | 7.08 | 4.96 |
| intein(Ala127)-Cas9 (SEQ ID NO:28) | 7.97 | 19.73 |
| intein(Thr146)-Cas9 (SEQ ID NO:29) | 8.77 | 21.60 |
| intein(Ser219)-Cas9 (SEQ ID NO:30) | 6.53 | 23.98 |
| intein(Thr333)-Cas9 (SEQ ID NO:31) | 4.96 | 9.17 |
| intein(Thr519)-Cas9 (SEQ ID NO:32) | 9.49 | 25.96 |
| intein(Cys574)-Cas9 (SEQ ID NO:33) | 5.74 | 21.44 |
| intein(Thr622)-Cas9 (SEQ ID NO:34) | 5.67 | 3.96 |
| intein(Ser701)-Cas9 (SEQ ID NO:35) | 6.54 | 9.56 |
| intein(Ala728)-Cas9 (SEQ ID NO:36) | 20.82 | 41.89 |
| intein(Thr995)-Cas9 (SEQ ID NO:37) | 14.95 | 21.39 |
| intein(Ser1006)-Cas9 (SEQ ID NO:38) | 6.80 | 12.61 |
| intein(Ser1154)-Cas9 (SEQ ID NO:39) | 21.14 | 41.94 |
| intein(Ser1159)-Cas9 (SEQ ID NO:40) | 5.65 | 13.21 |
| intein(Ser1274)-Cas9 (SEQ ID NO:41) | 3.08 | 5.00 |

TABLE 2

| | Cells without GFP (%) | | | | | |
|---|---|---|---|---|---|---|
| | | +4-HT | | | | |
| Cas9 Variant | −4-HT | 2 hrs | 4 hrs | 8 hrs | 12 hrs | 24 hrs |
| None | 2.98 | 2.60 | 3.78 | 3.71 | 2.76 | 2.82 |
| wild-type cas9 | 34.65 | 42.28 | 37.68 | 33.89 | 33.81 | 37.26 |
| intein(Ala127)-Cas9 (SEQ ID NO: 28) | 5.03 | 18.95 | 18.57 | 18.64 | 18.35 | 16.83 |
| intein (Thr146)-Cas9 (SEQ ID NO: 29) | 4.28 | 16.29 | 15.07 | 13.65 | 14.44 | 19.57 |
| intein (Ser219)-Cas9 (SEQ ID NO: 30) | 3.92 | 17.25 | 17.07 | 15.12 | 15.28 | 24.39 |
| intein (Thr519)-Cas9 (SEQ ID NO: 32) | 4.29 | 14.55 | 13.98 | 14.74 | 13.93 | 18.04 |
| intein (Cys574)-Cas9 (SEQ ID NO: 33) | 2.91 | 14.57 | 13.11 | 16.91 | 16.10 | 14.52 |

Example 2: Small Molecule-Controlled Cas9 Protein with Improved Genome-Editing Specificity Cas9 nucleases that are activated by the presence of a cell-permeable small molecule were developed by inserting an evolved 4-hydroxytamoxifen (4-HT)-responsive intein at specific positions in Cas9. In human cells, conditionally active Cas9s modify target genomic sites with up to 25-fold higher specificity than wild-type Cas9.

The RNA-guided endonuclease Cas9 from the type II CRISPR-Cas system enables simple and efficient genome editing in a wide variety of organisms. Virtually any target DNA locus can be cleaved by programming Cas9 with a single guide RNA (sgRNA) that contains a stretch of ~20 nucleotides complementary to the target sequence[1-3]. Due to its simplicity and robustness, the Cas9 system has been widely adopted for biological research and therapeutic development. The DNA cleavage specificity of Cas9 is imperfect[4-8], however, raising concerns over off-target genome modification that may limit its usefulness in therapeutic or research applications. Cas9 off-target activity has been reduced through protein[9-12] and sgRNA[13] engineering, and by direct delivery of Cas9:sgRNA protein:RNA complexes into cells[14-16].

A complementary, underexplored strategy to improve Cas9 specificity is to reduce its activity once it has had sufficient opportunity to modify the target DNA locus. Indeed, higher concentrations of Cas9 in cells have been observed to degrade specificity[4-6] (defined as the ratio of on-target:off-target DNA cleavage activity), presumably because any Cas9 protein present after the target locus has been modified can only process off-target substrates. Unfortunately, wild-type Cas9 nucleases are not known to be regulated by other molecules and therefore are used in constitutively active form. While Cas9 can be regulated at the transcriptional level through the use of inducible promoters[17,18], transcriptional control cannot limit activity to the short temporal windows that may be necessary to maximize genome-editing specificity[16,19], in contrast with the high temporal resolution of post-translational strategies that directly control protein activity.

Engineered variants of Cas9 that can be controlled with a readily available, cell-permeable small molecule were developed. We previously evolved inteins that undergo protein splicing only in the presence of 4-hydroxytamoxifen (4-HT)[20]. These inteins were developed by inserting the human estrogen receptor ligand-binding domain into the *M. tuberculosis* RecA intein and evolving the resulting inactive fusion protein into a conditionally active intein that requires the presence of 4-HT[20-22]. Subsequent evolution at 37° C. yielded a second-generation intein, 37R3-2, with improved splicing properties in mammalian cells[22]. We envisioned that inserting the 37R3-2 intein into Cas9 at a location that disrupts Cas9 activity until protein splicing has taken place could result in conditionally active Cas9 nucleases that are active only in the presence of 4-HT (FIG. 3a).

Figure 3:
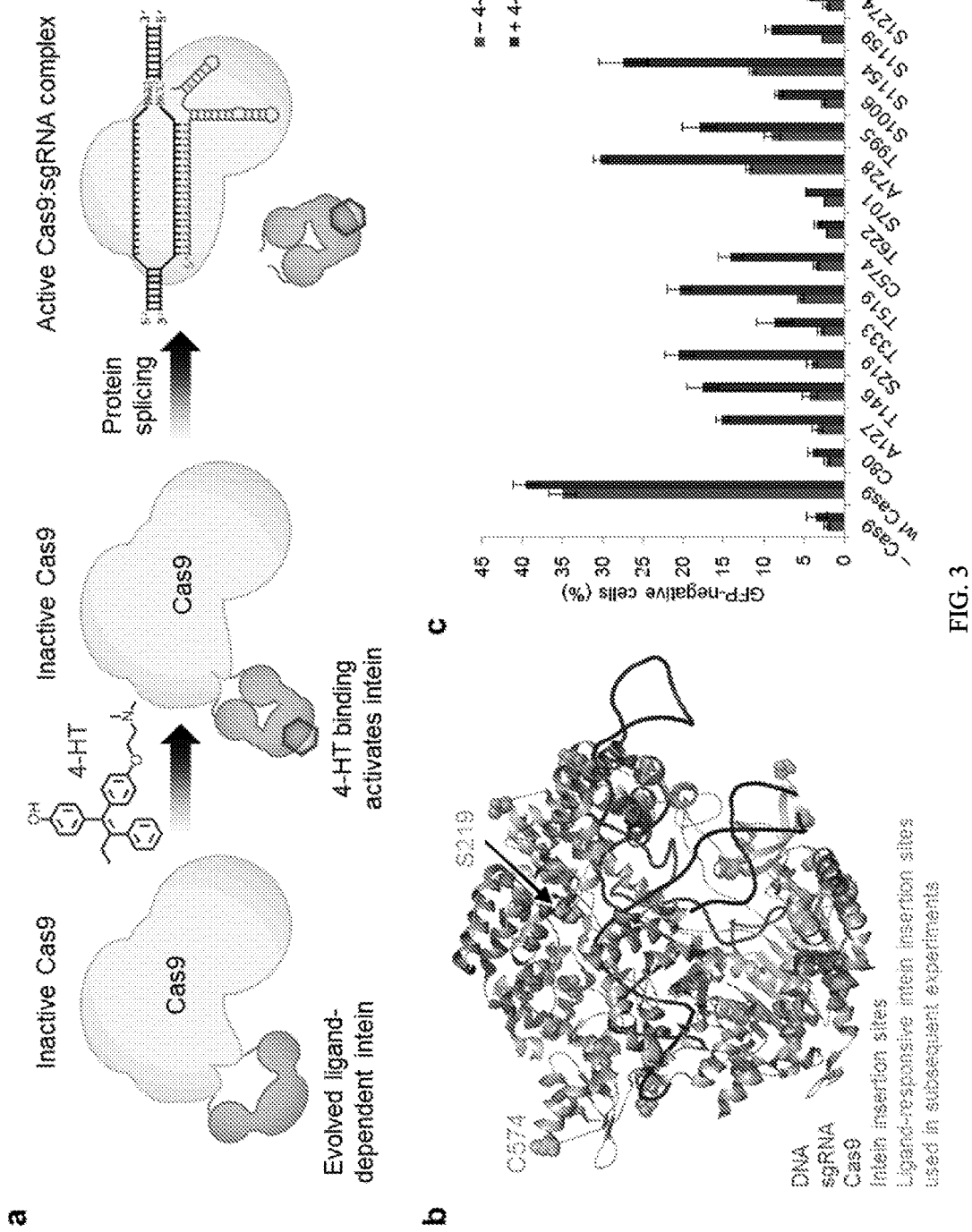
FIG. 3A-C. Insertion of an evolved ligand-dependent intein enables small-molecule control of Cas9. (A) Intein insertion renders Cas9 inactive. Upon 4-HT binding, the intein undergoes conformational changes that trigger protein splicing and restore Cas9 activity. (B) The evolved intein was inserted to replace each of the colored residues. Intein-inserted Cas9 variants at S219 and C574 (green) were used in subsequent experiments. (C) Genomic EGFP disruption activity of wild-type Cas9 and intein-Cas9 variants in the absence or presence of 4-HT. Intein-Cas9 variants are identified by the residue replaced by the intein. Error bars reflect the standard deviation of three biological replicates.

We genetically inserted the 4-HT-dependent intein at each of fifteen positions in Cas9 (Cys80, Ala127, Thr146, Ser219, Thr333, Thr519, Cys574, Thr622, Ser701, Ala728, Thr995, Ser1006, Ser1154, Ser1159, and Ser1274), chosen to distribute the location of the intein across the structural domains of Cas9[23] (FIG. 3b and Example 1). Because intein splicing leaves behind a single Cys residue, the intein was inserted in place of one Cas9 amino acid in each of the 15 candidate constructs. In addition to replacing natural Cys amino acids, we also favored replacing Ala, Ser, or Thr residues to minimize the likelihood that the resulting Cys point mutation resulting from protein splicing would disrupt Cas9 activity. The 15 intein-Cas9 candidates were expressed in HEK293-GFP cells together with a sgRNA that targets the genomic EGFP locus in these cells. Twelve hours post-transfection, cells were treated with or without 1 µM 4-HT. Five days post-transfection, cells were analyzed on a flow cytometer for loss of GFP expression from Cas9-mediated EGFP cleavage and subsequent non-homologous end joining.

Eight of the candidates, corresponding to intein insertion at A127, T146, S219, T333, T519, C574, S1006, and S1159, demonstrated 4-HT-dependent loss of GFP expression consistent with 4-HT-triggered Cas9 activity (FIG. 3c). Interestingly, three intein-Cas9 proteins (insertion at A728, T995, and S1154) showed high DNA modification rates both in the presence and absence of 4-HT, suggesting that large protein insertions at these positions do not significantly inhibit nuclease activity, or that the intein lost its 4-HT dependence due to context-dependent conformational perturbations. We speculate that it may be possible to engineer split Cas9 variants by dividing the protein at these locations, given their tolerance of a 413-residue insertion. The lack of nuclease activity of the remaining four Cas9-inteins (insertion at C80, T622, S701, and S1274) in the presence or absence of 4-HT could result from the inability of the intein to splice in those contexts, the inability of Cas9 to refold properly following splicing, or intolerance of replacement of native Thr or Ser residues with Cys. We pursued two intein-Cas9 variants corresponding to insertion at S219 and C574 (FIG. 3b). These two variants combined high activity in the presence of 4-HT and low activity in the absence of 4-HT.

Figure 5:
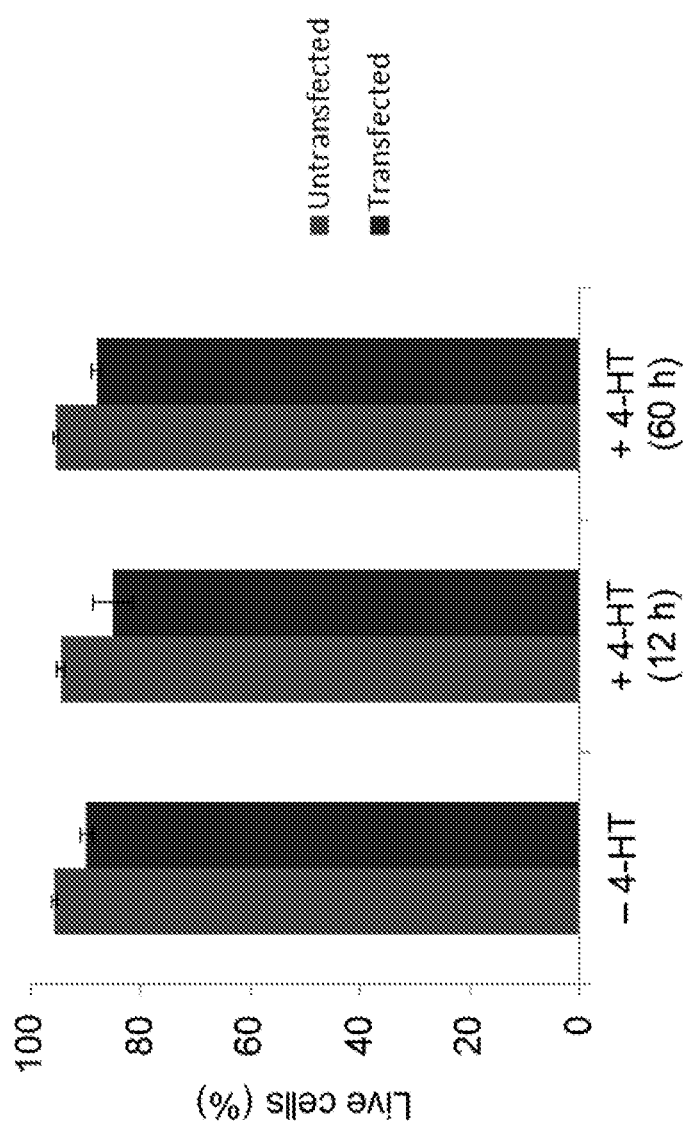
FIG. 5. Effect of 4-HT on cellular toxicity. Untransfected HEK293-GFP stable cells, and cells transfected with intein-Cas9(S219) and sgRNA expression plasmids, were treated with or without 4-HT (1 μM). 12 h after transfection, the media was replaced with full serum media, with or without 4-HT (1 μM). Cells were thus exposed to 4-HT for 0, 12, or 60 h. The live cell population was determined by flow cytometry 60 h after transfection using TO-PRO-3 stain (Life Technologies). Error bars reflect the standard deviation of six technical replicates.
Figure 6:
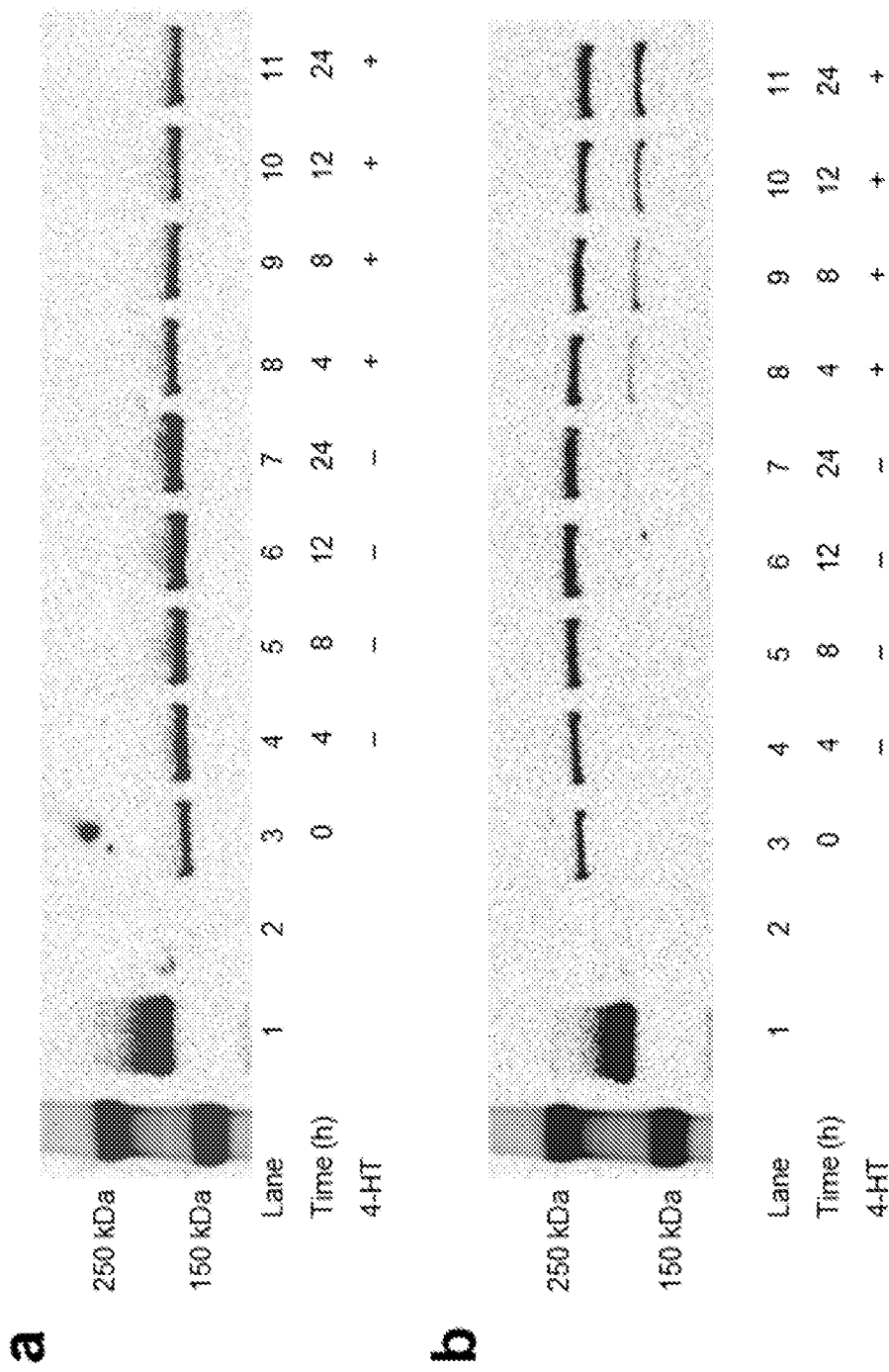
FIG. 6A-B. Western blot analysis of HEK293-GFP stable cells transfected with (A) wild-type Cas9 or (B) intein-Cas9 (S219) expression plasmid. 12 h after transfection, cells were treated with or without 4-HT (1 μM). Cells were lysed and pooled from three technical replicates 4, 8, 12, or 24 h after 4-HT treatment. An anti-FLAG antibody (Sigma-Aldrich F1804) and an anti-mouse 800CW IRDye (LI-COR) were used to visualize the gel. Lanes 1 and 2 contain purified dCas9-VP64-3xFLAG protein and lysate from untransfected HEK293 cells, respectively.

To evaluate the genome modification specificity of conditionally active Cas9 variants, we expressed intein-Cas9 (S219), intein-Cas9(C574), and wild-type Cas9 in HEK293-GFP cells together with each of three previously described[11] sgRNAs that target the well-studied EMX, VEGF, and CLTA genomic loci. We assayed these Cas9:sgRNA combinations in human cells for their ability to modify the three on-target loci as well as 11 known off-target genomic sites (Table 3)[4,5,10,13]. Cells were treated with or without 1 µM 4-HT during transfection, and after 12 h the media was replaced with fresh media lacking 4-HT. We observed no cellular toxicity arising from 12 or 60 h of treatment with 1 µM 4-HT in untransfected or transfected HEK293 cells (FIG. 5). Genomic DNA was isolated 60 h post-transfection and analyzed by high-throughput DNA sequencing Overall on-target genome modification frequency of intein-Cas9(S219) and intein-Cas9 (C574) in the presence of 1 µM 4-HT was similar to that of wild-type Cas9 (FIG. 4a, Tables 4 and 5). On-target modification frequency in the presence of 4-HT was 3.4- to 7.3-fold higher for intein-Cas9 (S219), and 3.6- to 9.6-fold higher for intein-Cas9(C574), than in the absence of 4-HT, whereas modification efficiency for wild-type Cas9 was 1.2- to 1.8-fold lower in the presence of 4-HT (FIG. 4a). Both intein-Cas9 variants exhibited a low level of background activity in the absence of 4-HT, consistent with previous reports[20-22]. Western blot analysis of intein-Cas9(S219) from transfected HEK293 cells confirmed the presence of spliced product at the earliest assayed time point (4 h) following 4-HT treatment; no spliced product was detected in the absence of 4-HT (FIG. 6). Together, these results indicate that intein-Cas9(S219) and intein-Cas9(C574) are slightly less active than wild-type Cas9 in the presence of 4-HT, likely due to incomplete splicing (FIG. 6), but much less active in the absence of 4-HT.

Figure 7:
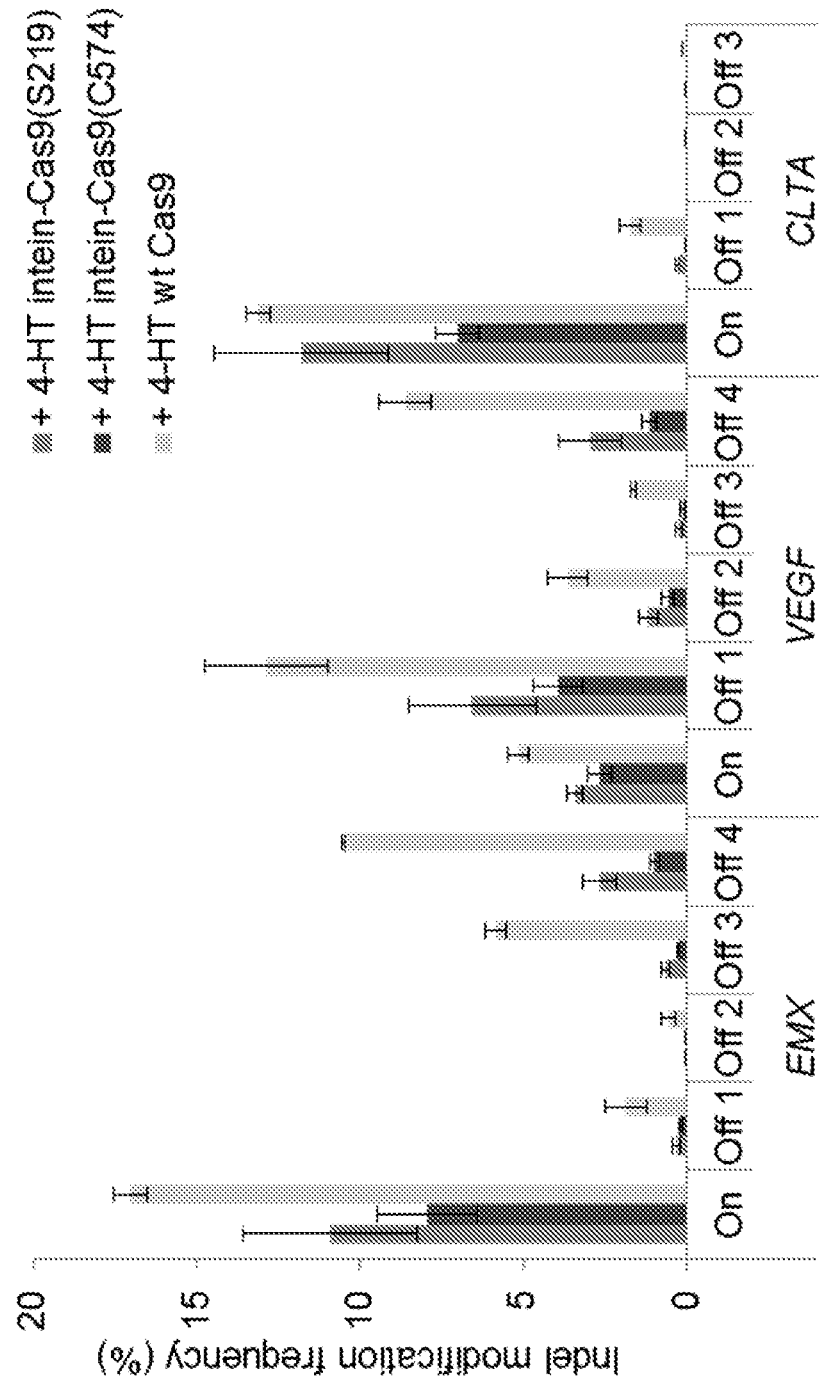
FIG. 7. Indel frequency from high-throughput DNA sequencing of amplified genomic on-target sites ("On") and off-target sites ("Off 1-Off 4") by intein-Cas9(S219), intein-Cas9(C574), and wild-type Cas9 in the presence of 4-HT. 500 ng of Cas9 expression plasmid was transfected. The higher observed efficiency of VEGF Off 1 modification than VEGF on-target modification is consistent with a previous report. P-values are <0.005 for the Fisher exact test (one-sided down) on all pairwise comparisons within each independent experiment of off-target modification frequency between either intein-Cas9 variant in the presence of 4-HT versus that of wild-type Cas9 in the presence of 4-HT. P-values were adjusted for multiple comparisons using the Benjamini-Hochberg method, and are listed in Table 7. Error bars reflect the range of two independent experiments conducted on different days. See also Fu, Y. et al. High-frequency off-target mutagenesis induced by CRISPR-Cas nucleases in human cells. *Nature biotechnology* 31, 822-826 (2013).

High-throughput sequencing of 11 previously described off-target sites that are modified by wild-type Cas9:sgRNA complexes targeting the EMX, VEGF, and CLTA loci revealed that both intein-Cas9 variants when treated with 4-HT for 12 h exhibit substantially improved specificity compared to that of wild-type Cas9 (FIG. 7, Tables 4, 6, and 7). On-target:off-target indel modification ratios for both intein-Cas9 variants were on average 6-fold higher, and as much as 25-fold higher, than that of wild-type Cas9 (FIG. 4b-d). In the absence of 4-HT, the genome modification specificity of both intein-Cas9 variants was on average 14-fold higher than that of wild-type Cas9 in the absence of 4-HT (FIG. 8), presumably resulting from the much lower activity of the intein-Cas9 variants in the absence of 4-HT[4-6].

Figure 9:
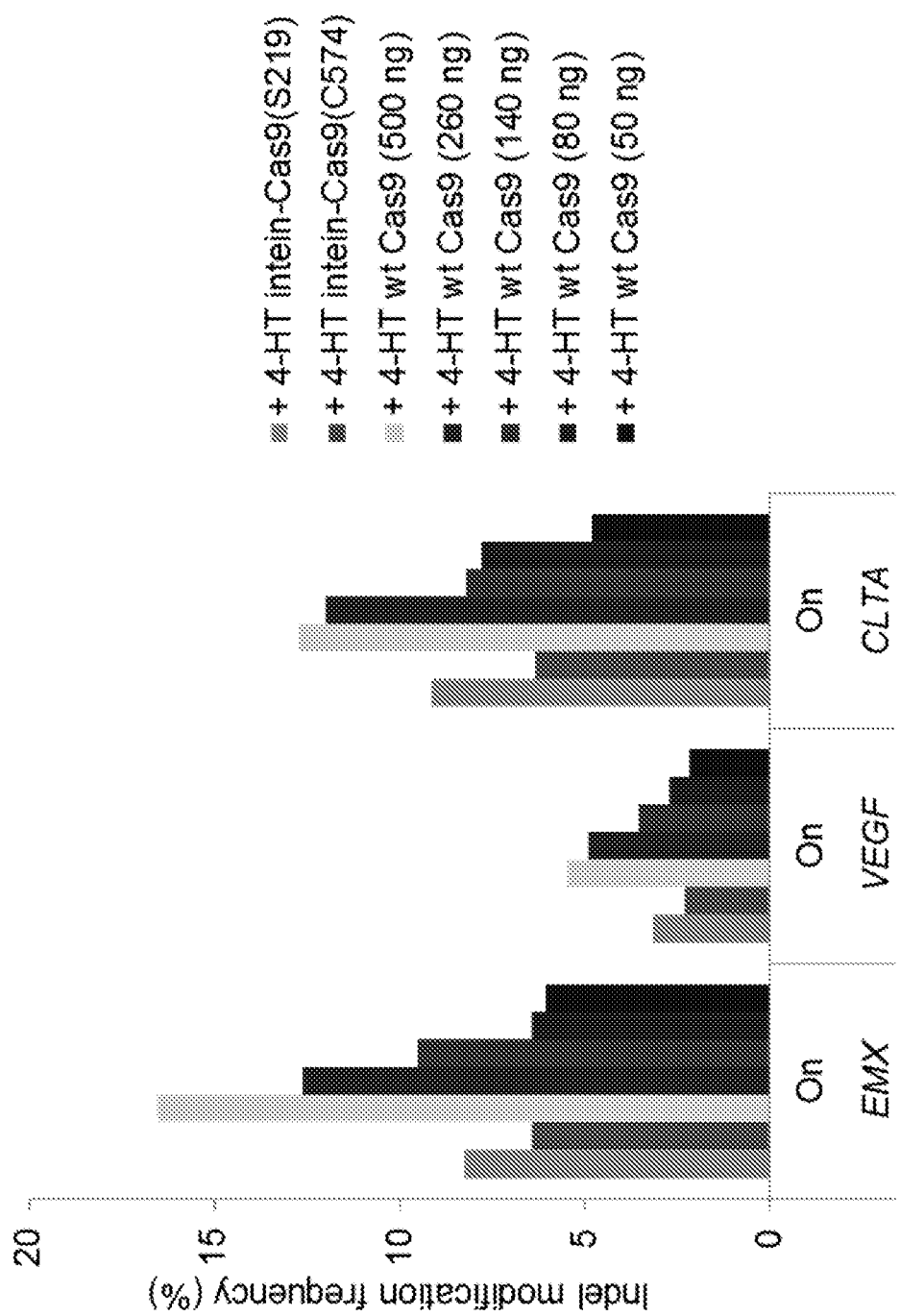
FIG. 9. Genomic on-target DNA modification by intein-Cas9(S219), intein-Cas9(C574), and wild-type Cas9 in the presence of 4-HT. Five different amounts of wild-type Cas9 expression plasmid, specified in parenthesis, were transfected. P-values for comparisons between conditions (Table 8) were obtained using the Fisher exact test and adjusted for multiple comparisons using the Benjamini-Hochberg Method.
Figure 10:
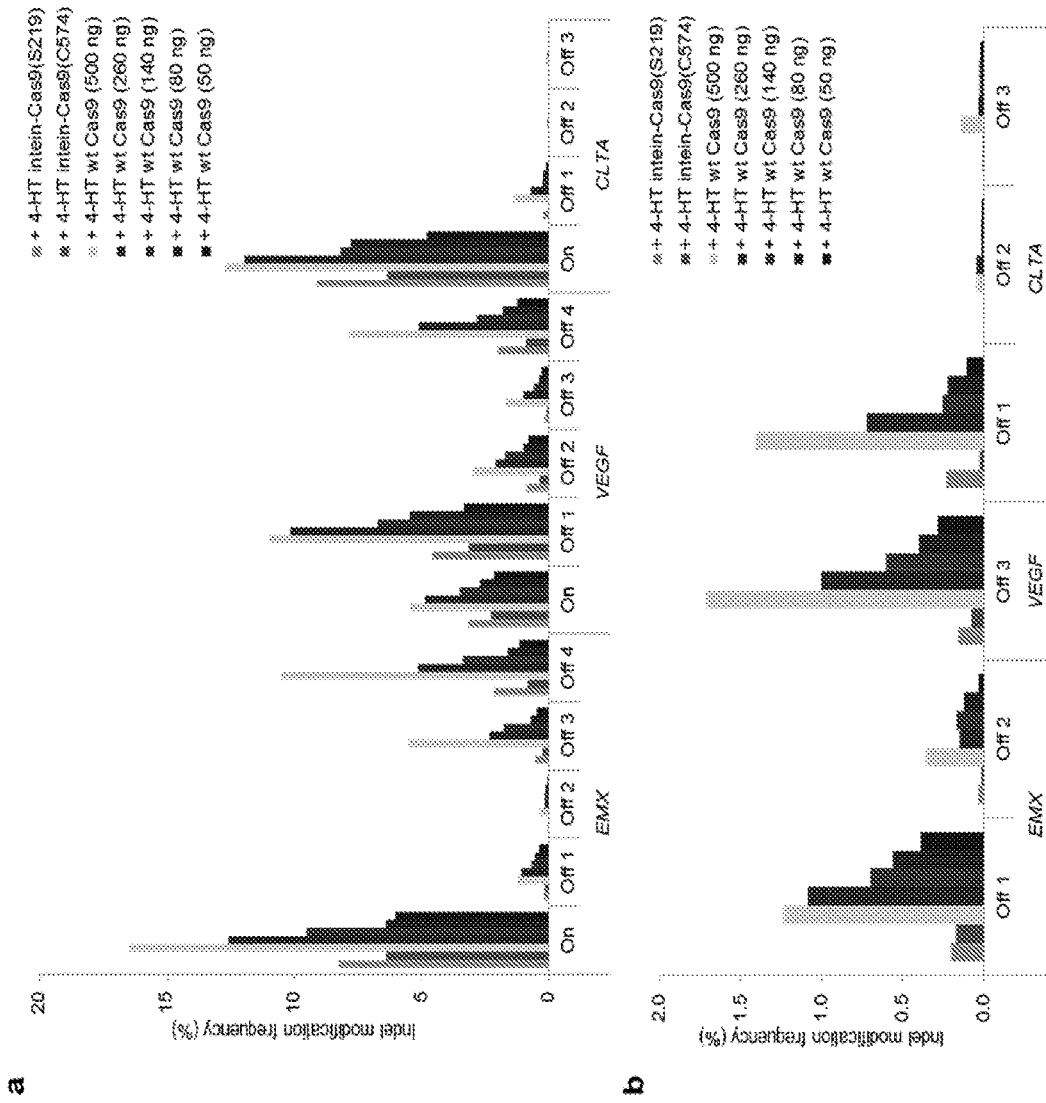
FIG. 10A-B. Indel frequency from high-throughput DNA sequencing of amplified genomic on-target sites ("On") and off-target sites ("Off 1-Off 4") by intein-Cas9(S219), intein-Cas9(C574), and wild-type Cas9 in the presence of 4-HT. Five different amounts of wild-type Cas9 expression plasmid, specified in parenthesis, were transfected (A). Genomic sites with low modification frequencies are enlarged in (B). P-values for comparisons between conditions (Table 8) were obtained using the Fisher exact test and adjusted for multiple comparisons using the Benjamini-Hochberg Method.
Figure 11:
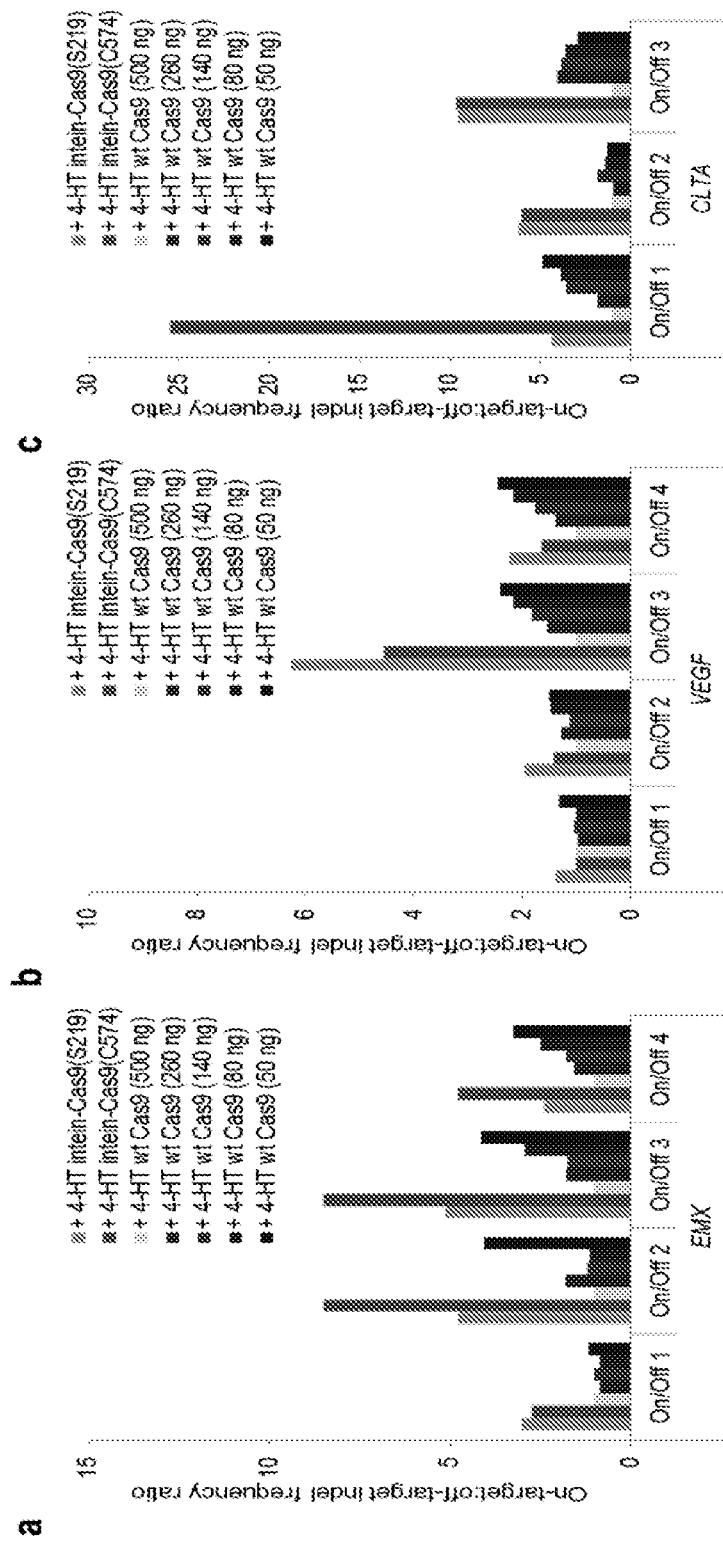
FIG. 11A-C. DNA modification specificity of intein-Cas9 (S219), intein-Cas9(C574), and wild-type Cas9 in the presence of 4-HT. (A-C) On-target:off-target indel frequency ratio normalized to wild-type Cas9 (500 ng). Five different amounts of wild-type Cas9 expression plasmid, specified in parenthesis, were transfected.

Since intein-Cas9s can result in slightly lower on-target modification rates compared to wild-type Cas9 (FIG. 4a), we sought to verify that the improvements in specificity among the intein-Cas9s were not simply a result of reduced activity. Both on- and off-target activity of Cas9 has been shown to be dependent on the amount of Cas9 expression plasmid transfected[4-6]. By transfecting lower amounts of the wild-type Cas9 expression plasmid, we compared intein-Cas9s with wild-type Cas9 under conditions that result in very similar levels of on-target modification. To minimize potential differences in transfection efficiency, we supplemented with a plasmid that does not express Cas9 so that the same total amount of plasmid DNA was transfected into each sample. High-throughput sequencing revealed that wild-type Cas9 shows slightly improved specificity, as expected, as the on-target cleavage rate is reduced. The intein-Cas9 variants, however, remain substantially more specific than wild-type Cas9 at similar on-target DNA cleavage rates (FIGS. 9-11, Tables 6 and 8). For example, intein-Cas9(C574) and wild-type Cas9 (80 ng) have virtually identical on-target DNA cleavage rates (both 6.4%) at the EMX locus but all four off-target sites are modified at an average of 4-fold lower frequencies ($P<1\times10^{-13}$) by intein-Cas9(C574) than by wild-type Cas9. These findings indicate that specificity improvements of intein-Cas9 variants do not simply arise from differences in overall genome editing activity.

Figure 12:
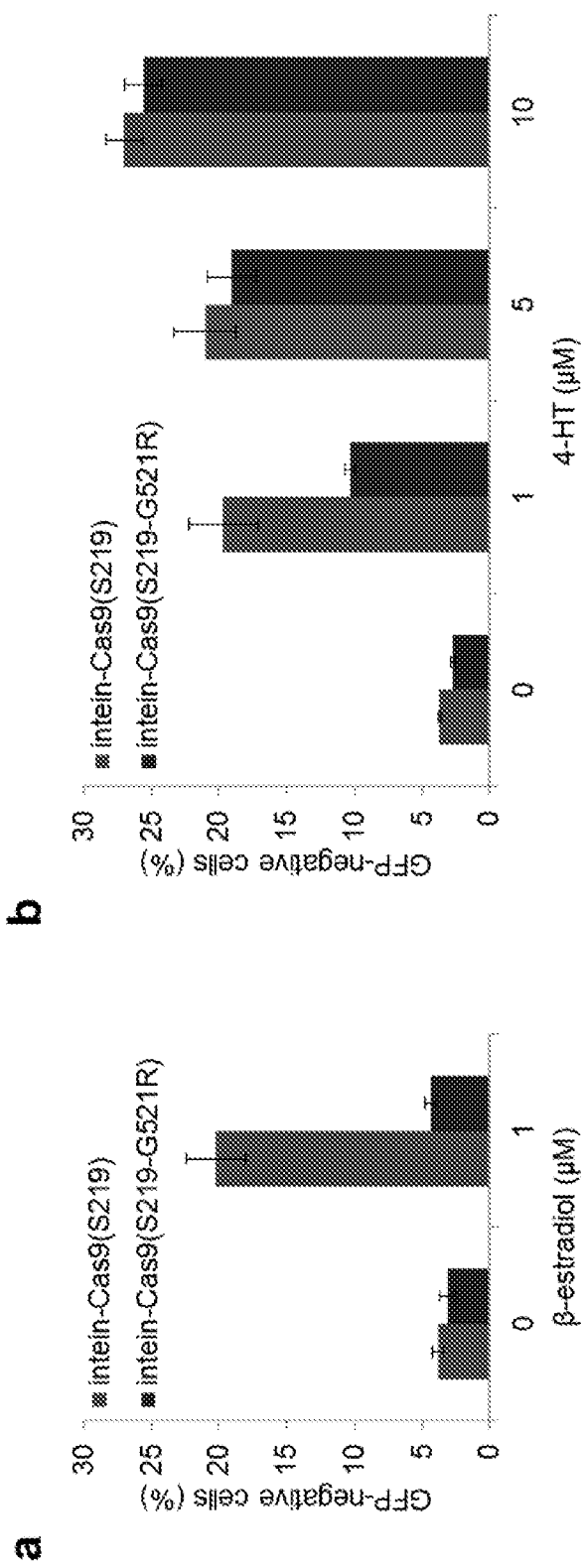
FIG. 12A-B. Genomic EGFP disruption activity of intein-Cas9(S219) and intein-Cas9(S219-G521R) in the presence of (A) β-estradiol or (B) 4-HT. Error bars reflect the standard deviation of three technical replicates.

Intein 37R3-2 can be activated by other estrogen receptor modulators. To enable intein-Cas9 applications in which endogenous β-estradiol is present, we inserted into the estrogen receptor ligand-binding domain a point mutation (G521R) that renders the domain more specific for 4-HT[24]. This mutation slightly reduces affinity for 4-HT but almost abolishes affinity for β-estradiol. The addition of this mutation to intein-Cas9(S219) eliminates the ability of β-estradiol to trigger Cas9 activity (FIG. 12).

The intein-Cas9 variants developed here demonstrate small-molecule control of Cas9 function, thereby enhancing genome-modification specificity. The use of ligand-dependent Cas9 variants provides greater control over genomic modification efficiencies and specificities than is currently achievable with constitutively active or transcriptionally regulated genome editing. This approach can synergize with other specificity-augmenting strategies such as direct delivery of transient Cas9 protein into cells[16], using truncated guide RNAs[13], paired Cas9 nickases, or Fok9I10-dCas9 fusions[11,12]. This approach could also be applied to other genome engineering proteins to enable, for example, small-molecule control of TALE-based or Cas9-mediated transcriptional regulators.

TABLE 3

On-target and 11 known off-target substrates of Cas9:sgRNAs that target sites in EMX, VEGF, and CLTA.

| | | |
|---|---|---|
| EMX On | GAGTCCGAGCAGAAGAAGAAGGG | (SEQ ID NO: XX) |
| EMX Off 1 | GAGgCCGAGCAGAAGAAagACGG | (SEQ ID NO: XX) |
| EMX Off 2 | GAGTCCtAGCAGgAGAAGAAGaG | (SEQ ID NO: XX) |
| EMX Off 3 | GAGTCtaAGCAGAAGAAGAAGaG | (SEQ ID NO: XX) |
| EMX Off 4 | GAGTtaGAGCAGAAGAAGAAAGG | (SEQ ID NO: XX) |
| VEGF On | GGGTGGGGGGAGTTTGCTCCTGG | (SEQ ID NO: XX) |
| VEGF Off 1 | GGaTGGaGGGAGTTTGCTCCTGG | (SEQ ID NO: XX) |
| VEGF Off 2 | GGGaGGGtGGAGTTTGCTCCTGG | (SEQ ID NO: XX) |
| VEGF Off 3 | cGGgGGaGGGAGTTTGCTCCTGG | (SEQ ID NO: XX) |
| VEGF Off 4 | GGGgaGGGGaAGTTTGCTCCTGG | (SEQ ID NO: XX) |
| CLTA On | GCAGATGTAGTGTTTCCACAGGG | (SEQ ID NO: XX) |
| CLTA Off 1 | aCAtATGTAGTaTTTCCACAGGG | (SEQ ID NO: XX) |
| CLTA Off 2 | cCAGATGTAGTaTTcCCACAGGG | (SEQ ID NO: XX) |
| CLTA Off 3 | ctAGATGaAGTGcTTCCACATGG | (SEQ ID NO: XX) |

List of genomic on-target and off-targets sites of the EMX, VEGF, and CLTA sites are shown with mutations from the on-target sequence shown in lower case.
Protospacer-adjacent motifs (PAMs) are shown underlined.

TABLE 4

Figure 4:
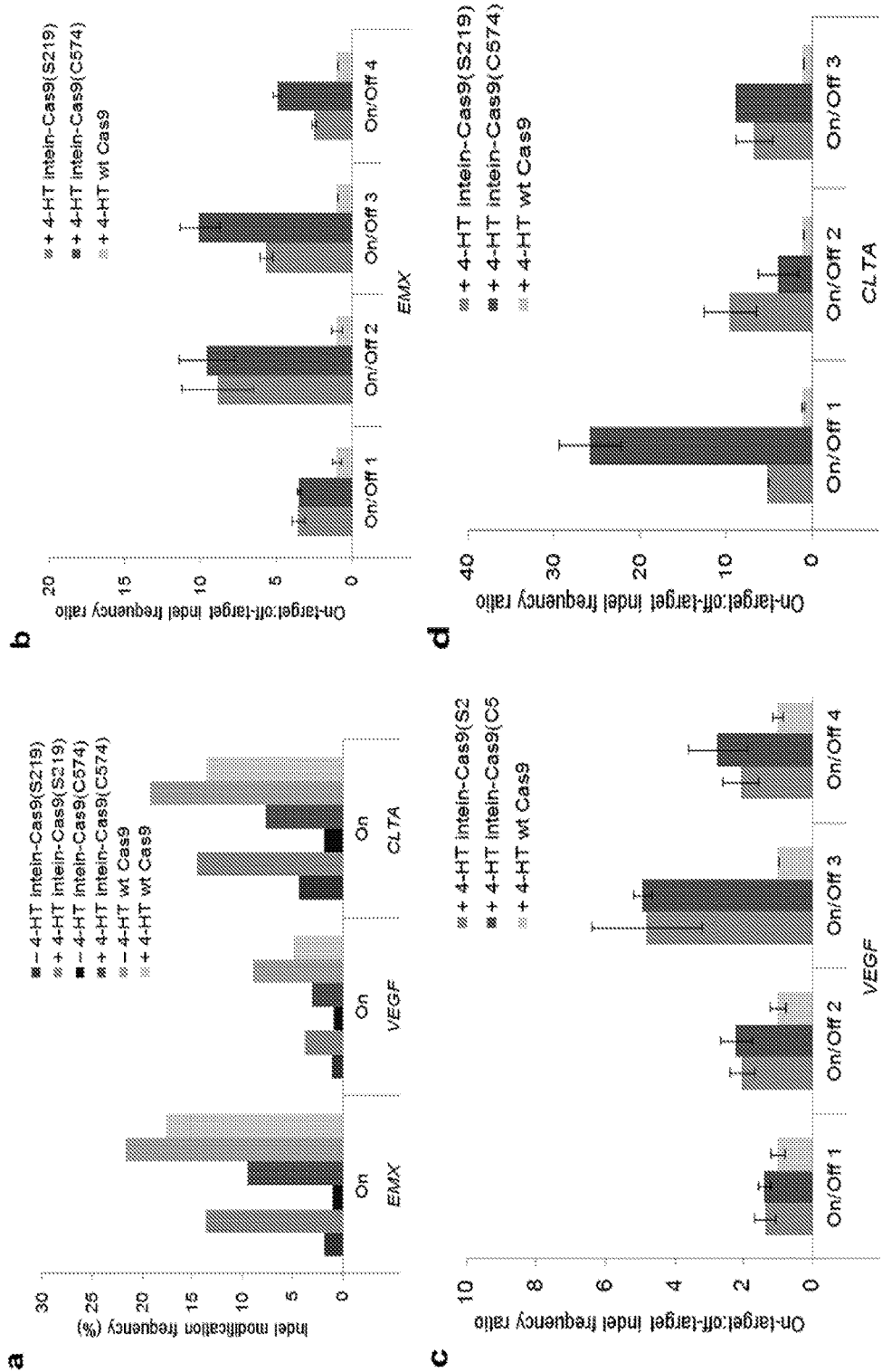
FIG. 4A-D. Genomic DNA modification by intein-Cas9 (S219), intein-Cas9(C574), and wild-type Cas9. (A) Indel frequency from high-throughput DNA sequencing of amplified genomic on-target sites in the absence or presence of 4-HT. Note that a significant number of indels were observed at the CLTA on-target site even in the absence of a targeting sgRNA (Table 9). (B-D) DNA modification specificity, defined as on-target:off-target indel frequency ratio[4-6], normalized to wild-type Cas9. Cells were transfected with 500 ng of the Cas9 expression plasmid. P-values are $<10^{-15}$ for the Fisher exact test (one-sided up) on comparisons of indel modification frequency in the presence versus the absence of 4-HT for intein-Cas9(S219) and intein-Cas9(C574). P-values were adjusted for multiple comparisons using the Benjamini-Hochberg method, and are listed in Table 5. Error bars reflect the range of two independent experiments conducted on different days.
Figure 8:
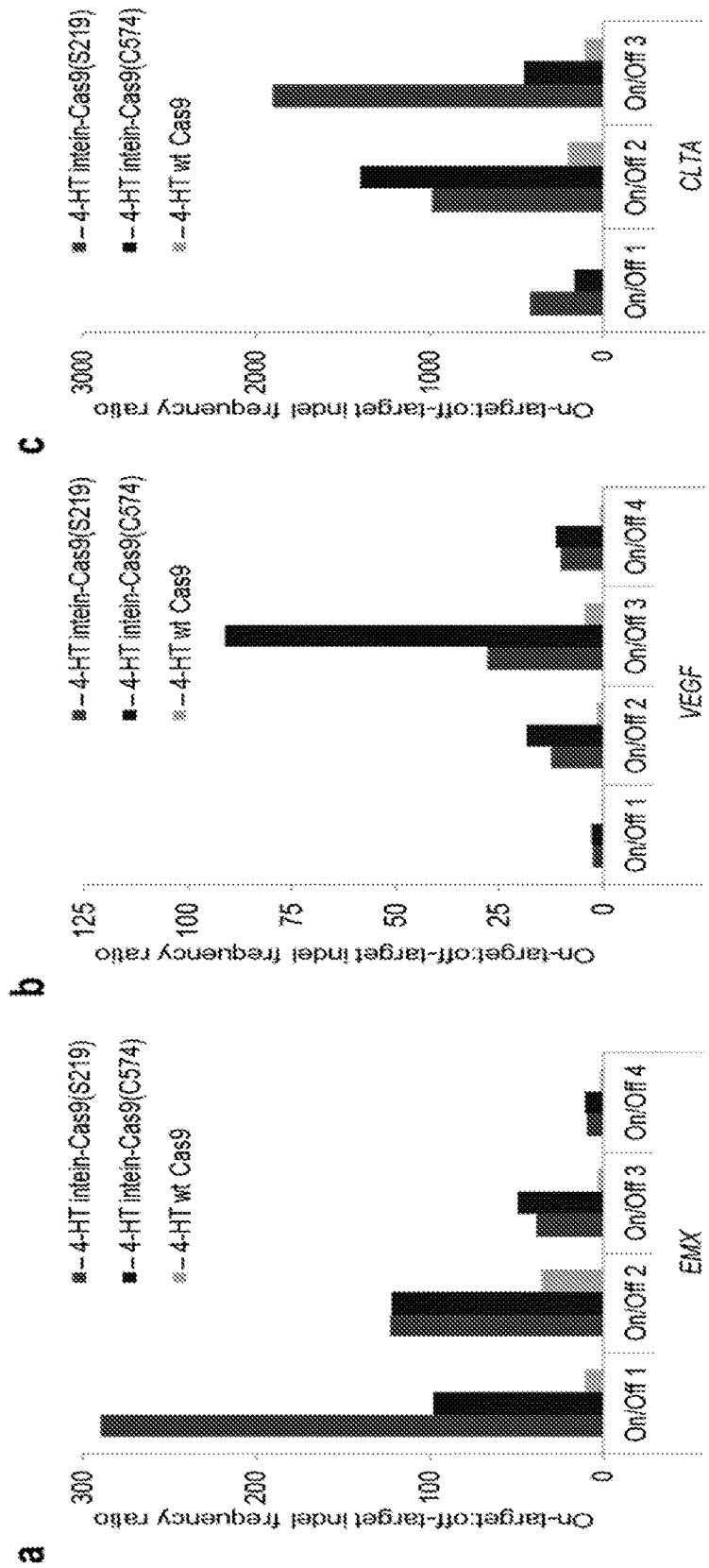
FIG. 8A-C. DNA modification specificity of intein-Cas9 (S219), intein-Cas9(C574), and wild-type Cas9 in the absence of 4-HT. (A-C) On-target:off-target indel frequency ratio following the transfection of 500 ng of intein-Cas9 (S219), intein-Cas9(C574), or wild-type Cas9 expression plasmid.

Raw sequence counts and modification frequencies for data plotted in FIGS. 4, 7, and 8. Total: total number of sequence counts. Modification frequency: number of indels divided by the total number of sequences listed as percentages.

| | −4H intein-Cs (S 19) | | | −4H intein-Cs (C 74) | | | −4H w C s9 (50 ng) | | | +4-H intein-Cas (S 19) | | | +4-H intein-Cas (C 74) | | | +4-H w Cas (50 ng) | | |
|---|---|---|---|---|---|---|---|---|---|---|---|---|---|---|---|---|---|---|
| | Indel | Tota | Mod Fre | Indel | Tota | Mod Fre | Indel | Tota | Mod Fre | Indel | Tota | Mod Fre | Indel | Tota | Mod Fre | Indel | Tota | Mod Fre |
| EMO | 12 | 597 | 1.7% | 56 | 570 | 0.9% | 159 | 717 | 216% | 73 | 574 | 135% | 50 | 597 | 9.7% | 92 | 592 | 175% |
| EM Of 1 | 3 | 430 | 0.1% | 4 | 354 | 0.1% | 14 | 534 | 2.7% | 18 | 454 | 0.2% | 11 | 442 | 0.7% | 14 | 437 | 2.2% |
| EM Of 2 | 8 | 532 | 0.2% | 3 | 393 | 0.1% | 54 | 895 | 0.0% | 2 | 597 | 0.4% | 2 | 654 | 0.4% | 41 | 570 | 0.8% |
| EM Of 3 | 3 | 642 | 0.5% | 1 | 452 | 0.2% | 50 | 821 | 6.7% | 41 | 589 | 0.7% | 16 | 510 | 0.9% | 44 | 613 | 6.8% |
| EM Of 4 | 14 | 763 | 0.9% | 5 | 696 | 0.9% | 187 | 856 | 136% | 21 | 745 | 3.6% | 57 | 587 | 1.3% | 66 | 661 | 104% |
| VEG O | 35 | 309 | 1.5% | 37 | 481 | 0.5% | 31 | 472 | 8.3% | 18 | 305 | 3.6% | 17 | 399 | 3.3% | 12 | 217 | 4.4% |
| VEG Of 1 | 21 | 433 | 0.3% | 11 | 438 | 0.9% | 158 | 774 | 203% | 25 | 379 | 8.0% | 27 | 452 | 4.8% | 66 | 449 | 147% |
| VEG Of 2 | 2 | 352 | 0.8% | 1 | 273 | 0.5% | 25 | 475 | 5.3% | 28 | 136 | 1.9% | 27 | 323 | 0.7% | 19 | 217 | 4.6% |
| VEG Of 3 | 1 | 464 | 0.4% | 4 | 411 | 0.1% | 14 | 818 | 2.2% | 16 | 453 | 0.7% | 10 | 597 | 0.9% | 67 | 465 | 1.9% |
| VEG Of 4 | 5 | 572 | 0.0% | 3 | 406 | 0.7% | 114 | 1698 | 121% | 16 | 369 | 3.9% | 12 | 802 | 1.0% | 35 | 346 | 9.5% |
| CLT O | 28 | 456 | 4.0% | 93 | 520 | 1.1% | 190 | 847 | 191% | 59 | 320 | 144% | 44 | 585 | 7.5% | 77 | 501 | 135% |
| CL A Of 1 | 8 | 708 | 0.1% | 8 | 756 | 0.1% | 36 | 1154 | 3.2% | 28 | 786 | 0.6% | 3 | 799 | 0.4% | 16 | 716 | 2.3% |
| CL A Of 2 | 3 | 613 | 0.0% | 0 | 778 | 0.0% | 7 | 701 | 0.0% | 0 | 209 | 0.0% | 1 | 637 | 0.2% | 1 | 383 | 0.5% |
| CL A Of 3 | 1 | 432 | 0.0% | 2 | 497 | 0.0% | 9 | 500 | 0.8% | 1 | 324 | 0.3% | 4 | 484 | 0.1% | 7 | 530 | 0.3% |

TABLE 5

P-values for comparisons between conditions in FIG. 2a. P-values were obtained using the Fisher exact test and adjusted for multiple comparisons using the Benjamini-Hochberg Method.

| | intein-Cas9(S219) (+4-HT vs. −4-HT) | intein-Cas9(C574) (+4-HT vs. −4-HT) | wt Cas9 (+4-HT vs. −4-HT) |
|---|---|---|---|
| EMX On | $<3.3 \times 10^{-16}$ | $<3.3 \times 10^{-16}$ | 1 |
| VEGF On | $<3.3 \times 10^{-16}$ | $<3.3 \times 10^{-16}$ | 1 |
| CLTA On | $<3.3 \times 10^{-16}$ | $<3.3 \times 10^{-16}$ | 1 |

TABLE 6

Raw sequence counts and modification frequencies for data plotted in FIG. 4b -d, and 9-11. Total: total number of sequence counts. Modification frequency: number of indels divided by the total number of sequences listed as percentages.

| | +4-H intein-Ca (S21 | | | +4-H intein-Ca (C57 | | | +4-H w Cas (50 ng | | | +4-H w Cas (26 ng | |
|---|---|---|---|---|---|---|---|---|---|---|---|
| | Indel | Tot | Mo Fre | Indel | Tot | Mo Fre | Indel | Tot | Mo Fre | Indel | Tot |
| EM O | 544 | 6603 | 8.2% | 412 | 6426 | 6.4% | 1045 | 6322 | 16.5% | 683 | 5423 |
| EM Of 1 | 13 | 6543 | 0.2% | 11 | 6575 | 0.1% | 46 | 3768 | 1.2% | 48 | 4481 |
| EM Of 2 | 2 | 6992 | 0.0% | 1 | 6118 | 0.0% | 23 | 6593 | 0.3% | 9 | 6252 |
| EM Of 3 | 43 | 8169 | 0.5% | 17 | 6878 | 0.2% | 489 | 8869 | 5.5% | 176 | 7480 |
| EM Of 4 | 190 | 8767 | 2.1% | 70 | 8286 | 0.8% | 699 | 6638 | 10.5% | 413 | 8009 |
| VEG O | 163 | 5154 | 3.1% | 133 | 5769 | 2.3% | 207 | 3791 | 5.4% | 187 | 3818 |
| VEG Of 1 | 313 | 6790 | 4.6% | 197 | 6213 | 3.1% | 847 | 7694 | 11.0% | 589 | 5800 |
| VEG Of 2 | 34 | 3856 | 0.9% | 18 | 4992 | 0.3% | 100 | 3329 | 3.0% | 66 | 3147 |
| VEG Of 3 | 8 | 5287 | 0.1% | 4 | 5897 | 0.0% | 108 | 6336 | 1.7% | 49 | 4879 |
| VEG Of 4 | 106 | 5266 | 2.0% | 84 | 9259 | 0.9% | 371 | 4732 | 7.8% | 383 | 7487 |
| CLT O | 423 | 4633 | 9.1% | 309 | 4875 | 6.3% | 758 | 5958 | 12.7% | 574 | 4791 |
| CL A Of 1 | 16 | 7288 | 0.2% | 2 | 7248 | 0.0% | 124 | 8842 | 1.4% | 57 | 7976 |
| CL A Of 2 | 2 | 4088 | 0.0% | 2 | 5673 | 0.0% | 2 | 6343 | 0.0% | 2 | 6435 |
| CL A Of 3 | 5 | 4559 | 0.0% | 3 | 3974 | 0.0% | 7 | 4930 | 0.1% | 1 | 4750 |

| | +4-H w Cas (26 ng | +4-H w Cas (14 ng | | | +4-H w Cas (8 ng | | | +4-H w Cas (5 ng | | |
|---|---|---|---|---|---|---|---|---|---|---|
| | Mo Fre | Indel | Tot | Mo Fre | Indel | Tot | Mo Fre | Indel | Tot | Mo Fre |
| EM O | 12.6% | 621 | 6522 | 9.5% | 367 | 5714 | 6.4% | 355 | 5868 | 6.0% |
| EM Of 1 | 1.0% | 37 | 5327 | 0.7% | 28 | 4992 | 0.5% | 19 | 5034 | 0.3% |
| EM Of 2 | 0.1% | 11 | 6740 | 0.1% | 7 | 6150 | 0.1% | 1 | 5879 | 0.0% |
| EM Of 3 | 2.3% | 140 | 7742 | 1.8% | 50 | 6958 | 0.7% | 31 | 6381 | 0.4% |
| EM Of 4 | 5.1% | 306 | 8965 | 3.4% | 137 | 8319 | 1.6% | 93 | 7809 | 1.1% |
| VEG O | 4.9% | 165 | 4694 | 3.5% | 120 | 4442 | 2.7% | 99 | 4571 | 2.1% |
| VEG Of 1 | 10.1% | 407 | 6055 | 6.7% | 288 | 5251 | 5.4% | 179 | 5373 | 3.3% |
| VEG Of 2 | 2.1% | 52 | 3023 | 1.7% | 38 | 3794 | 1.0% | 28 | 3493 | 0.8% |
| VEG Of 3 | 1.0% | 29 | 4874 | 0.6% | 18 | 4614 | 0.4% | 14 | 5050 | 0.2% |
| VEG Of 4 | 5.1% | 189 | 6657 | 2.8% | 122 | 6739 | 1.8% | 69 | 5451 | 1.2% |
| CLT O | 11.9% | 459 | 5606 | 8.1% | 386 | 4953 | 7.8% | 224 | 4651 | 4.8% |
| CL A Of 1 | 0.7% | 22 | 8702 | 0.2% | 17 | 7882 | 0.2% | 7 | 6876 | 0.1% |
| CL A Of 2 | 0.0% | 1 | 7457 | 0.0% | 7 | 3816 | 0.0% | 6 | 4693 | 0.0% |
| CL A Of 3 | 0.0% | 1 | 4908 | 0.0% | 1 | 4877 | 0.0% | 8 | 4249 | 0.0% |

TABLE 7

P-values for comparisons between conditions in FIG. 7. P-values were obtained using the Fisher exact test and adjusted for multiple comparisons using the Benjamini-Hochberg Method.

| | Independent Experiment 1 | | Independent Experiment 2 | |
|---|---|---|---|---|
| | +4-HT intein-Cas9(S219) vs. +4-HT wt Cas9 (500 ng) | +4-HT intein-Cas9(C574) vs. +4-HT wt Cas9 (500 ng) | +4-HT intein-Cas9(S219) vs. +4-HT wt Cas9 (500 ng) | +4-HT intein-Cas9(C574) vs. +4-HT wt Cas9 (500 ng) |
| EMX On | $<2.4 \times 10^{-16}$ | $<2.4 \times 10^{-16}$ | $<3.9 \times 10^{-16}$ | $<3.9 \times 10^{-16}$ |
| EMX Off 1 | $<2.4 \times 10^{-16}$ | $<2.4 \times 10^{-16}$ | $<3.9 \times 10^{-16}$ | $<3.9 \times 10^{-16}$ |
| EMX Off 2 | $<2.4 \times 10^{-16}$ | $<2.4 \times 10^{-16}$ | $<3.9 \times 10^{-16}$ | $<3.9 \times 10^{-16}$ |
| EMX Off 3 | $<2.4 \times 10^{-16}$ | $<2.4 \times 10^{-16}$ | $<3.9 \times 10^{-16}$ | $<3.9 \times 10^{-16}$ |
| EMX Off 4 | $<2.4 \times 10^{-16}$ | $<2.4 \times 10^{-16}$ | $<3.9 \times 10^{-16}$ | $<3.9 \times 10^{-16}$ |
| VEGF On | $2.8 \times 10^{-12}$ | $<2.4 \times 10^{-16}$ | $<3.9 \times 10^{-16}$ | $<3.9 \times 10^{-16}$ |
| VEGF Off 1 | $<2.4 \times 10^{-16}$ | $<2.4 \times 10^{-16}$ | $<3.9 \times 10^{-16}$ | $<3.9 \times 10^{-16}$ |
| VEGF Off 2 | $<2.4 \times 10^{-16}$ | $<2.4 \times 10^{-16}$ | $<3.9 \times 10^{-16}$ | $<3.9 \times 10^{-16}$ |
| VEGF Off 3 | $<2.4 \times 10^{-16}$ | $<2.4 \times 10^{-16}$ | $<3.9 \times 10^{-16}$ | $<3.9 \times 10^{-16}$ |
| VEGF Off 4 | $<2.4 \times 10^{-16}$ | $<2.4 \times 10^{-16}$ | $<3.9 \times 10^{-16}$ | $<3.9 \times 10^{-16}$ |
| CLTA On | 1 | $<2.4 \times 10^{-16}$ | $<3.9 \times 10^{-16}$ | $<3.9 \times 10^{-16}$ |
| CLTA Off 1 | $<2.4 \times 10^{-16}$ | $<2.4 \times 10^{-16}$ | $<3.9 \times 10^{-16}$ | $<3.9 \times 10^{-16}$ |
| CLTA Off 2 | $9.1 \times 10^{-5}$ | $4.4 \times 10^{-3}$ | $1.4 \times 10^{-4}$ | $4.6 \times 10^{-6}$ |
| CLTA Off 3 | $1.3 \times 10^{-7}$ | $1.5 \times 10^{-14}$ | $3.1 \times 10^{-15}$ | $3.5 \times 10^{-15}$ |

TABLE 8

P-values for comparisons between conditions in FIGS. 9 and 10. All conditions were treated with 4-HT. P-values were obtained using the Fisher exact test and adjusted for multiple comparisons using the Benjamini-Hochberg Method.

| | intein C s9S 19 vs w Cas9 (50 ng) | intein C s9S 19 vs w Cas9 (26 ng) | intein C s9S 19 vs w Cas9 (14 ng) | intein C s9S 19 vs w Cas9 (8 ng) | intein C s9S 19 vs w Cas9 (5 ng) | intein C s9C 74) vs w Cas9 (50 ng) | intein C s9C 74) vs w Cas9 (26 ng) | intein C s9C 74) vs w Cas9 (14 ng) | intein C s9C 74) vs w Cas9 (8 ng) | intein C s9C 74) vs w Cas9 (5 ng) |
|---|---|---|---|---|---|---|---|---|---|---|
| EM O | $<3. \times 1^{-1}$ | $<3. \times 1^{-1}$ | $<3. \times 1^{-1}$ | 1 | 1 | $<3. \times 1^{-1}$ | $<3. \times 1^{-1}$ | $<3. \times 1^{-1}$ | 0.5 | 1 |
| EM Of 1 | $<3. \times 1^{-1}$ | $<3. \times 1^{-1}$ | $<3. \times 1^{-1}$ | $<3. \times 1^{-1}$ | $6. \times 10^{-}$ | $<3. \times 1^{-1}$ | $<3. \times 1^{-1}$ | $<3. \times 1^{-1}$ | $<3. \times 1^{-1}$ | $3. \times 10^{-1}$ |
| EM Of 2 | $<3. \times 1^{-1}$ | $4. \times 10^{-1}$ | $2. \times 10^{-1}$ | $1. \times 10^{-}$ | 0.8 | $<3. \times 1^{-1}$ | $<3. \times 1^{-1}$ | $<3. \times 1^{-1}$ | $1. \times 10^{-1}$ | $7. \times 10^{-}$ |
| EM Of 3 | $<3. \times 1^{-1}$ | $<3. \times 1^{-1}$ | $<3. \times 1^{-1}$ | $2. \times 10^{-}$ | 1 | $<3. \times 1^{-1}$ | $<3. \times 1^{-1}$ | $<3. \times 1^{-1}$ | $<3. \times 1^{-1}$ | $7. \times 10^{-1}$ |
| EM Of 4 | $<3. \times 1^{-1}$ | $<3. \times 1^{-1}$ | $<3. \times 1^{-1}$ | 1 | 1 | $<3. \times 1^{-1}$ | $<3. \times 1^{-1}$ | $<3. \times 1^{-1}$ | $<3. \times 1^{-1}$ | $1. \times 10^{-1}$ |
| VEG O | $<3. \times 1^{-1}$ | $<3. \times 1^{-1}$ | $1. \times 10^{-}$ | 1 | 1 | $<3. \times 1^{-1}$ | $<3. \times 1^{-1}$ | $<3. \times 1^{-1}$ | $1. \times 10^{-}$ | 1 |
| VEG Of 1 | $<3. \times 1^{-1}$ | $<3. \times 1^{-1}$ | $<3. \times 1^{-1}$ | $3. \times 10^{-1}$ | 1 | $<3. \times 1^{-1}$ | $<3. \times 1^{-1}$ | $<3. \times 1^{-1}$ | $<3. \times 1^{-1}$ | $9. \times 10^{-}$ |
| VEG Of 2 | $<3. \times 1^{-1}$ | $<3. \times 1^{-1}$ | $<3. \times 1^{-1}$ | $5. \times 10^{-}$ | 1 | $<3. \times 1^{-1}$ | $<3. \times 1^{-1}$ | $<3. \times 1^{-1}$ | $<3. \times 1^{-1}$ | $<3. \times 1^{-1}$ |
| VEG Of 3 | $<3. \times 1^{-1}$ | $<3. \times 1^{-1}$ | $<3. \times 1^{-1}$ | $5. \times 10^{-1}$ | $1. \times 10^{-}$ | $<3. \times 1^{-1}$ | $<3. \times 1^{-1}$ | $<3. \times 1^{-1}$ | $<3. \times 1^{-1}$ | $<3. \times 1^{-1}$ |
| VEG Of 4 | $<3. \times 1^{-1}$ | $<3. \times 1^{-1}$ | $<3. \times 1^{-1}$ | 1 | 1 | $<3. \times 1^{-1}$ | $<3. \times 1^{-1}$ | $<3. \times 1^{-1}$ | $<3. \times 1^{-1}$ | $9. \times 10^{-}$ |
| CLT O | $<3. \times 1^{-1}$ | $<3. \times 1^{-1}$ | 1 | 1 | 1 | $<3. \times 1^{-1}$ | $<3. \times 1^{-1}$ | $<3. \times 1^{-1}$ | $<3. \times 1^{-1}$ | 1 |
| CLT Of 1 | $<3. \times 1^{-1}$ | $<3. \times 1^{-1}$ | 0.2 | 0.7 | 1 | $<3. \times 1^{-1}$ | $<3. \times 1^{-1}$ | $<3. \times 1^{-1}$ | $<3. \times 1^{-1}$ | $2. \times 10^{-}$ |
| CLT Of 2 | $1. \times 10^{-}$ | $1. \times 10^{-}$ | 0.1 | $9. \times 10^{-}$ | 0.2 | $4. \times 10^{-}$ | $5. \times 10^{-}$ | $4. \times 10^{-}$ | $3. \times 10^{-}$ | 0.1 |
| CLT Of 3 | $3. \times 10^{-1}$ | $2. \times 10^{-}$ | 0.1 | 0.1 | 0.2 | $3. \times 10^{-1}$ | $9. \times 10^{-}$ | $5. \times 10^{-}$ | $5. \times 10^{-}$ | 0.1 |

TABLE 9

Raw sequence counts and modification frequencies (for cells transfected with wild-type Cas9 (500 ng) but without a targeting sgRNA, in the presence of 4-HT). Total: total number of sequence counts. Modification frequency: number of indels divided by the total number of sequences listed as percentages.

| | + 4-HT wt Cas9 (500 ng) -sgRNA | | |
|---|---|---|---|
| | Indels | Total | Modification frequency |
| EMX On | 8 | 78943 | 0.01% |
| EMX Off 1 | 1 | 42232 | 0.00% |
| EMX Off 2 | 4 | 79008 | 0.01% |
| EMX Off 3 | 60 | 113629 | 0.05% |
| EMX Off 4 | 5 | 104159 | 0.00% |
| VEGF On | 0 | 60667 | 0.00% |
| VEGF Off 1 | 2 | 111409 | 0.00% |
| VEGF Off 2 | 0 | 52048 | 0.00% |
| VEGF Off 3 | 4 | 88105 | 0.00% |
| VEGF Off 4 | 2 | 123559 | 0.00% |
| CLTA On | 491 | 68600 | 0.72% |
| CLTA Off 1 | 10 | 116033 | 0.01% |
| CLTA Off 2 | 6 | 75723 | 0.01% |
| CLTA Off 3 | 4 | 53885 | 0.01% |

Sequences

```
Intein 37R32:
TGCCTTGCCGAGGGTACCCGAATCTTCGATCCGGTCACTGGTACAACGCATCGCA
TCGAGGATGTTGTCGATGGGCGCAAGCCTATTCATGTCGTGGCTGCTGCCAAGGA
CGGAACGCTGCTCGCGCGGCCCGTGGTGTCCTGGTTCGACCAGGGAACGCGGGA
TGTGATCGGGTTGCGGATCGCCGGTGGCGCCATCGTGTGGGCGACACCCGATCAC
AAGGTGCTGACAGAGTACGGCTGGCGTGCCGCCGGGGAACTCCGCAAGGGAGAC
AGGGTGGCCGGACCGGGTGGTTCTGGTAACAGCCTGGCCTTGTCCCTGACGGCCG
ACCAGATGGTCAGTGCCTTGTTGGATGCTGAGCCCCCCATACTCTATTCCGAGTA
TGATCCTACCAGTCCCTTCAGTGAAGCTTCGATGATGGGCTTACTGACCAACCTG
GCAGACAGGGAGCTGGTTCACATGATCAACTGGGCGAAGAGGGTGCCAGGCTTT
GTGGATTTGACCCTCCATGATCAGGCCCACCTTCTAGAACGTGCCTGGCTAGAGA
TCCTGATGATTGGTCTCGTCTGGCGCTCCATGGAGCACCCAGGGAAGCTACTGTT
TGCTCCTAACTTGCTCTTGGACAGGAACCAGGGAAAATGTGTAGAGGGCATGGT
GGAGATCTTCGACATGCTGCTGGCTACATCATCTCGGTTCCGCATGATGAATCTG
CAGGGAGAGGAGTTTGTGTGCCTCAAATCTATTATTTTGCTTAATTCTGGAGTGT
ACACATTTCTGTCCAGCACCCTGAAGTCTCTGGAAGAGAAGGACCATATCCACCG
AGCCCTGGACAAGATCACGGACACTTTGATCCACCTGATGGCCAAGGCAGGCCT
GACCCTGCAGCAGCAGCACCAGCGGCTGGCCCAGCTCCTCCTCATCCTCTCCCAC
ATCAGGCACATGAGTAACAAAGGAATGGAGCATCTGTACAGCATGAAGTACAAG
AACGTGGTGCCCCTCTATGACCTGCTGCTGGAGATGTGGACGCCCACCGCCTAC
ATGCGGGTGGTTCTGGTGCTAGCCGCGTGCAGGCGTTCGCGGATGCCCTGGATGA
CAAATTCCTGCACGACATGCTGGCGGAAGGACTCCGCTATTCCGTGATCCGAGAA
GTGCTGCCAACGCGGCGGGCACGAACGTTCGACCTCGAGGTCGAGGAACTGCAC
ACCCTCGTCGCCGAAGGGGTTGTCGTGCACAACTGC (SEQ ID NO: XX)

Cas9-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
```

| Sequences |
| --- |
| RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVGTALIKKYPKLESEFVYGDYKVYDVRKMIAKSEQEIGK
ATAKYFFYSNIMNFFKTEITLANGEIRKRPLIETNGETGEIVWDKGRDFATVRKVLSM
PQVNIVKKTEVQTGGFSKESILPKRNSDKLIARKKDWDPKKYGGFDSPTVAYSVLVV
AKVEKGKSKKLKSVKELLGITIMERSSFEKNPIDFLEAKGYKEVKKDLIIKLPKYSLFE
LENGRKRMLASAGELQKGNELALPSKYVNFLYLASHYEKLKGSPEDNEQKQLFVEQ
HKHYLDEIIEQISEFSKRVILADANLDKVLSAYNKHRDKPIREQAENIIHLFTLTNLGA
PAAFKYFDTTIDRKRYTSTKEVLDATLIHQSITGLYETRIDLSQLGGDSPKKKRKVSS
DYKDHDGDYKDHDIDYKDDDDKAAG (SEQ ID NO: XX)

Intein-Cas9(C80)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRI<u>CLAEGTRIFDPVTGTTHRIEDVVDGRKPIHVVAAA
KDGTLLARPVVSWFDQGTRDVIGLRIAGGAIVWATPDHKVLTEYGWRAAGELRKG
DRVAGPGGSGNSLALSLTADQMVSALLDAEPPILYSEYDPTSPFSEASMMGLLTNLA
DRELVHMINWAKRVPGFVDLTLHDQAHLLERAWLEILMIGLVWRSMEHPGKLLFAP
NLLLLDRNQGKCVEGMVEIFDMLLATSSRFRMMNLQGEEFVCLKSIILLNSGVYTFLS
STLKSLEEKDHIHRALDKITDTLIHLMAKAGLTLQQQHQRLAQLLLILSHIRHMSNKG
MEHLYSMKYKNVVPLYDLLLEMLDAHRLHAGGSGASRVQAFADALDDKFLHDML
AEGLRYSVIREVLPTRRARTFDLEVEELHTLVAEGVVVHNCYLQEIFSNEMAKVDDS</u>
FFHRLEESFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSASMIKRYDEH
HQDLTLLKALVRQQLPEKYKEIFFDQSKNGYAGYIDGGASQEEFYKFIKPILEKMDG
TEELLVKLNREDLLRKQRTFDNGSIPHQIHLGELHAILRRQEDFYPFLKDNREKIEKIL
TFRIPYYVGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILE
DIVLTLTLFEDREMIEERLKTYAHLFDDKVMKQLKRRRYTGWGRLSRKLINGIRDKQ
SGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDSPKKKRKVSSDYKDHDGDYKDHDIDYKDDDDKAAG (SEQ ID NO: XX)

Intein-Cas9(A127)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEV<u>CLAEGTRIFDPVTGTTHRIEDVVDGRKPIHVVAAAKDGTLLARPVV
SWFDQGTRDVIGLRIAGGAIVWATPDHKVLTEYGWRAAGELRKGDRVAGPGGSGN
SLALSLTADQMVSALLDAEPPILYSEYDPTSPFSEASMMGLLTNLADRELVHMINWA
KRVPGFVDLTLHDQAHLLERAWLEILMIGLVWRSMEHPGKLLFAPNLLLLDRNQGKC
VEGMVEIFDMLLATSSRFRMMNLQGEEFVCLKSIILLNSGVYTFLSSTLKSLEEKDHI
HRALDKITDTLIHLMAKAGLTLQQQHQRLAQLLLILSHIRHMSNKGMEHLYSMKYK
NVVPLYDLLLEMLDAHRLHAGGSGASRVQAFADALDDKFLHDMLAEGLRYSVIRE
VLPTRRARTFDLEVEELHTLVAEGVVVHNC</u>YHEKYPTIYHLRKKLVDSTDKADLRLI
YLALAHMIKFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSASMIKRYDEH
HQDLTLLKALVRQQLPEKYKEIFFDQSKNGYAGYIDGGASQEEFYKFIKPILEKMDG
TEELLVKLNREDLLRKQRTFDNGSIPHQIHLGELHAILRRQEDFYPFLKDNREKIEKIL
TFRIPYYVGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILE |

-continued

DIVLTLTLFEDREMIEERLKTYAHLFDDKVMKQLKRRRYTGWGRLSRKLINGIRDKQ
SGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDGSPKKKRKVSSDYKDHDGDYKDHDIDYKDDDDKAAG (SEQ ID NO: XX)

Intein-Cas9(T146)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDS<u>CLAEGTRIFDPVTGTTHRIEDVVDGRK
PIHVVAAAKDGTLLARPVVSWFDQGTRDVIGLRIAGGAIVWATPDHKVLTEYGWRA
AGELRKGDRVAGPGGSGNSLALSLTADQMVSALLDAEPPILYSEYDPTSPFSEASMM
GLLTNLADRELVHMINWAKRVPGFVDLTLHDQAHLLERAWLEILMIGLVWRSMEH
PGKLLFAPNLLLDRNQGKCVEGMVEIFDMLLATSSRFRMMNLQGEEFVCLKSIILLN
SGVYTFLSSTLKSLEEKDHIHRALDKITDTLIHLMAKAGLTLQQQHQRLAQLLLILSHI
RHMSNKGMEHLYSMKYKNVVPLYDLLLEMLDAHRLHAGGSGASRVQAFADALDD
KFLHDMLAEGLRYSVIREVLPTRRARTFDLEVEELHTLVAEGVVVHNCDKADLRLIY</u>
LALAHMIKFRGHFLIEGDLNPDNSDVDKLFIQLVQTYNQLFEENPINASGVDAKAILS
ARLSKSRRLENLIAQLPGEKKNGLFGNLIALSLGLTPNFKSNFDLAEDAKLQLSKDTY
DDDLDNLLAQIGDQYADLFLAAKNLSDAILLSDILRVNTEITKAPLSASMIKRYDEHH
QDLTLLKALVRQQLPEKYKEIFFDQSKNGYAGYIDGGASQEEFYKFIKPILEKMDGTE
ELLVKLNREDLLRKQRTFDNGSIPHQIHLGELHAILRRQEDFYPFLKDNREKIEKILTF
RIPYYVGPLARGNSRFAWMTRKSEETITPWNFEEVVDKGASAQSFIERMTNFDKNLP
NEKVLPKHSLLYEYFTVYNELTKVKYVTEGMRKPAFLSGEQKKAIVDLLFKTNRKV
TVKQLKEDYFKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLINGIRDKQS
GKTILDFLKSDGFANRNFMQLIHDDSLTFKEDIQKAQVSGQGDSLHEHIANLAGSPAI
KKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDGSPKKKRKVSSDYKDHDGDYKDHDIDYKDDDDKAAG (SEQ ID NO: XX)

Intein-Cas9(S219)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSK<u>CLAEGTRIFDPV
TGTTHRIEDVVDGRKPIHVVAAAKDGTLLARPVVSWFDQGTRDVIGLRIAGGAIVW
ATPDHKVLTEYGWRAAGELRKGDRVAGPGGSGNSLALSLTADQMVSALLDAEPPIL
YSEYDPTSPFSEASMMGLLTNLADRELVHMINWAKRVPGFVDLTLHDQAHLLERA
WLEILMIGLVWRSMEHPGKLLFAPNLLLDRNQGKCVEGMVEIFDMLLATSSRFRMM
NLQGEEFVCLKSIILLNSGVYTFLSSTLKSLEEKDHIHRALDKITDTLIHLMAKAGLTL
QQQHQRLAQLLLILSHIRHMSNKGMEHLYSMKYKNVVPLYDLLLEMLDAHRLHAG
GSGASRVQAFADALDDKFLHDMLAEGLRYSVIREVLPTRRARTFDLEVEELHTLVAE
GVVVHN</u>CRRLENLIAQLPGEKKNGLFGNLIALSLGLTPNFKSNFDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVDLLFKTNR
KVTVKQLKEDYFKKIECFDSVEISGVEDRFNASLGTYHDLLKIIKDKDFLDNEENEDI
LEDIVLTLTLFEDREMIEERLKTYAHLFDDKVMKQLKRRRYTGWGRLSRKLINGIRD
KQSGKTILDFLKSDGFANRNFMQLIHDDSLTFKEDIQKAQVSGQGDSLHEHIANLAG
SPAIKKGILQTVKVVDELVKVMGRHKPENIVIEMARENQTTQKGQKNSRERMKRIEE
GIKELGSQILKEHPVENTQLQNEKLYLYYLQNGRDMYVDQELDINRLSDYDVDHIVP
QSFLKDDSIDNKVLTRSDKNRGKSDNVPSEEVVKKMKNYWRQLLNAKLITQRKFDN
LTKAERGGLSELDKAGFIKRQLVETRQITKHVAQILDSRMNTKYDENDKLIREVKVIT
LKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP

| Sequences |
| --- |
| KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQSITGLYETRI
DLSQLGGDGSPKKKRKVSSDYKDHDGDYKDHDIDYKDDDDKAAG (SEQ ID NO: XX)

Intein-Cas9(T333)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLCLAEGTRIFDPVTG
TTHRIEDVVDGRKPIHVVAAAKDGTLLARPVVSWFDQGTRDVIGLRIAGGAIVWATP
DHKVLTEYGWRAAGELRKGDRVAGPGGSGNSLALSLTADQMVSALLDAEPPILYSE
YDPTSPFSEASMMGLLTNLADRELVHMINWAKRVPGFVDLTLHDQAHLLERAWLEI
LMIGLVWRSMEHPGKLLFAPNLLLDRNQGKCVEGMVEIFDMLLATSSRFRMMNLQ
GEEFVCLKSIILLNSGVYTFLSSTLKSLEEKDHIHRALDKITDTLIHLMAKAGLTLQQQ
HQRLAQLLLILSHIRHMSNKGMEHLYSMKYKNVVPLYDLLLEMLDAHRLHAGGSG
ASRVQAFADALDDKFLHDMLAEGLRYSVIREVLPTRRARTFDLEVEELHTLVAEGV
VVHNCLLKALVRQQLPEKYKEIFFDQSKNGYAGYIDGGASQEEFYKFIKPILEKMDG
TEELLVKLNREDLLRKQRTFDNGSIPHQIHLGELHAILRRQEDFYPFLKDNREKIEKIL
TFRIPYYVGPLARGNSRFAWMTRKSEETITPWNFEEVVDKGASAQSFIERMTNFDKN
LPNEKVLPKHSLLYEYFTVYNELTKVKYVTEGMRKPAFLSEGQKKAIVDLLFKTNRK
VTVKQLKEDYFKKIECFDSVEISGVEDRFNASLGTYHDLLKIIKDKDFLDNEENEDILE
DIVLTLTLFEDREMIEERLKTYAHLFDDKVMKQLKRRRYTGWGRLSRKLINGIRDKQ
SGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDGSPKKKRKVSSDYKDHDGDYKDHDIDYKDDDDKAAG (SEQ ID NO: XX)

Intein-Cas9(T519)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFCL
AEGTRIFDPVTGTTHRIEDVVDGRKPIHVVAAAKDGTLLARPVVSWFDQGTRDVIGL
RIAGGAIVWATPDHKVLTEYGWRAAGELRKGDRVAGPGGSGNSLALSLTADQMVS
ALLDAEPPILYSEYDPTSPFSEASMMGLLTNLADRELVHMINWAKRVPGFVDLTLHD
QAHLLERAWLEILMIGLVWRSMEHPGKLLFAPNLLLDRNQGKCVEGMVEIFDMLLA
TSSRFRMMNLQGEEFVCLKSIILLNSGVYTFLSSTLKSLEEKDHIHRALDKITDTLIHL
MAKAGLTLQQQHQRLAQLLLILSHIRHMSNKGMEHLYSMKYKNVVPLYDLLLEML
DAHRLHAGGSGASRVQAFADALDDKFLHDMLAEGLRYSVIREVLPTRRARTFDLEV
EELHTLVAEGVVVHNCVYNELTKVKYVTEGMRKPAFLSGEQKKAIVDLLFKTNRKV
TVKQLKEDYFKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLINGIRDKQS
GKTILDFLKSDGFANRNFMQLIHDDSLTFKEDIQKAQVSGQGDSLHEHIANLAGSPAI
KKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDGSPKKKRKVSSDYKDHDGDYKDHDIDYKDDDDKAAG (SEQ ID NO: XX)

Intein-Cas9(C574)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE |

Sequences

RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECLA
EGTRIFDPVTGTTHRIEDVVDGRKPIHVVAAAKDGTLLARPVVSWFDQGTRDVIGLRI
AGGAIVWATPDHKVLTEYGWRAAGELRKGDRVAGPGGSGNSLALSLTADQMVSAL
LDAEPPILYSEYDPTSPFSEASMMGLLTNLADRELVHMINWAKRVPGFVDLTLHDQA
HLLERAWLEILMIGLVWRSMEHPGKLLFAPNLLLDRNQGKCVEGMVEIFDMLLATS
SRFRMMNLQGEEFVCLKSIILLNSGVYTFLSSTLKSLEEKDHIHRALDKITDTLIHLMA
KAGLTLQQQHQRLAQLLLILSHIRHMSNKGMEHLYSMKYKNVVPLYDLLLEMLDA
HRLHAGGSGASRVQAFADALDDKFLHDMLAEGLRYSVIREVLPTRRARTFDLEVEE
LHTLVAEGVVVHNCFDSVEISGVEDRFNASLGTYHDLLKIIKDKDFLDNEENEDILED
IVLTLTLFEDREMIEERLKTYAHLFDDKVMKQLKRRRYTGWGRLSRKLINGIRDKQS
GKTILDFLKSDGFANRNFMQLIHDDSLTFKEDIQKAQVSGQGDSLHEHIANLAGSPAI
KKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDGSPKKKRKVSSDYKDHDGDYKDHDIDYKDDDDKAAG (SEQ ID NO: XX)

Intein-Cas9(T622)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLCLAEGTRIFDPVTG
TTHRIEDVVDGRKPIHVVAAAKDGTLLARPVVSWFDQGTRDVIGLRIAGGAIVWATP
DHKVLTEYGWRAAGELRKGDRVAGPGGSGNSLALSLTADQMVSALLDAEPPILYSE
YDPTSPFSEASMMGLLTNLADRELVHMINWAKRVPGFVDLTLHDQAHLLERAWLEI
LMIGLVWRSMEHPGKLLFAPNLLLDRNQGKCVEGMVEIFDMLLATSSRFRMMNLQ
GEEFVCLKSIILLNSGVYTFLSSTLKSLEEKDHIHRALDKITDTLIHLMAKAGLTLQQQ
HQRLAQLLLILSHIRHMSNKGMEHLYSMKYKNVVPLYDLLLEMLDAHRLHAGGSG
ASRVQAFADALDDKFLHDMLAEGLRYSVIREVLPTRRARTFDLEVEELHTLVAEGV
VVHNCLTLFEDREMIEERLKTYAHLFDDKVMKQLKRRRYTGWGRLSRKLINGIRDK
QSGKTILDFLKSDGFANRNFMQLIHDDSLTFKEDIQKAQVSGQGDSLHEHIANLAGSP
AIKKGILQTVKVVDELVKVMGRHKPENIVIEMARENQTTQKGQKNSRERMKRIEEGI
KELGSQILKEHPVENTQLQNEKLYLYYLQNGRDMYVDQELDINRLSDYDVDHIVPQ
SFLKDDSIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLIREVKVITL
KSKLVSDFRKDFQFYKVREINNYHHAHDAYLNAVVGTALIKKYPKLESEFVYGDYK
VYDVRKMIAKSEQEIGKATAKYFFYSNIMNFFKTEITLANGEIRKRPLIETNGETGEIV
WDKGRDFATVRKVLSMPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKG
YKEVKKDLIIKLPKYSLFELENGRKRMLASAGELQKGNELALPSKYVNFLYLASHYE
KLKGSPEDNEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQSITGLYETRID
LSQLGGDGSPKKKRKVSSDYKDHDGDYKDHDIDYKDDDDKAAG (SEQ ID NO: XX)

Intein-Cas9(S701)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL

| Sequences |
| --- |
| KTYAHLFDDKVMKQLKRRRYTGWGRLSRKLINGIRDKQSGKTILDFLKSDGFANRN
FMQLIHDD<u>CLAEGTRIFDPVTGTTHRIEDVVDGRKPIHVVAAAKDGTLLARPVVSWF
DQGTRDVIGLRIAGGAIVWATPDHKVLTEYGWRAAGELRKGDRVAGPGGSGNSLA
LSLTADQMVSALLDAEPPILYSEYDPTSPFSEASMMGLLTNLADRELVHMINWAKRV
PGFVDLTLHDQAHLLERAWLEILMIGLVWRSMEHPGKLLFAPNLLLDRNQGKCVEG
MVEIFDMLLATSSRFRMMNLQGEEFVCLKSIILLNSGVYTFLSSTLKSLEEKDHIHRA
LDKITDTLIHLMAKAGLTLQQQHQRLAQLLLILSHIRHMSNKGMEHLYSMKYKNVV
PLYDLLLEMLDAHRLHAGGSGASRVQAFADALDDKFLHDMLAEGLRYSVIREVLPT
RRARTFDLEVEELHTLVAEGVVVHNCLTFKEDIQKAQVSGQGDSLHEHIANLAGSPA</u>
IKKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDSPKKKRKVSSDYKDHDGDYKDHDIDYKDDDDKAAG (SEQ ID NO: XX)

Intein-Cas9(A728)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSD ILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANL<u>CLAEGTRIFDPVTGTTHRIEDVV
DGRKPIHVVAAAKDGTLLARPVVSWFDQGTRDVIGLRIAGGAIVWATPDHKVLTEY
GWRAAGELRKGDRVAGPGGSGNSLALSLTADQMVSALLDAEPPILYSEYDPTSPFSE
ASMMGLLTNLADRELVHMINWAKRVPGFVDLTLHDQAHLLERAWLEILMIGLVWR
SMEHPGKLLFAPNLLLDRNQGKCVEGMVEIFDMLLATSSRFRMMNLQGEEFVCLKS
IILLNSGVYTFLSSTLKSLEEKDHIHRALDKITDTLIHLMAKAGLTLQQQHQRLAQLLL
ILSHIRHMSNKGMEHLYSMKYKNVVPLYDLLLEMLDAHRLHAGGSGASRVQAFAD
ALDDKFLHDMLAEGLRYSVIREVLPTRRARTFDLEVEELHTLVAEGVVVHNCGSPAI</u>
KKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDSPKKKRKVSSDYKDHDGDYKDHDIDYKDDDDKAAG (SEQ ID NO: XX)

Intein-Cas9(T995)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVG<u>CLAEGTRIFDPVTGTTHRIEDVVDGRKPIHVVAAAKD
GTLLARPVVSWFDQGTRDVIGLRIAGGAIVWATPDHKVLTEYGWRAAGELRKGDR
VAGPGGSGNSLALSLTADQMVSALLDAEPPILYSEYDPTSPFSEASMMGLLTNLADR</u>

-continued

| Sequences |
|---|
| ELVHMINWAKRVPGFVDLTLHDQAHLLERAWLEILMIGLVWRSMEHPGKLLFAPNL
LLDRNQGKCVEGMVEIFDMLLATSSRFRMMNLQGEEFVCLKSIILLNSGVYTFLSSTL
KSLEEKDHIHRALDKITDTLIHLMAKAGLTLQQQHQRLAQLLLILSHIRHMSNKGME
HLYSMKYKNVVPLYDLLLEMLDAHRLHAGGSGASRVQAFADALDDKFLHDMLAE
GLRYSVIREVLPTRRARTFDLEVEELHTLVAEGVVVHNCALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQSITGLYETRI
DLSQLGGDGSPKKKRKVSSDYKDHDGDYKDHDIDYKDDDDKAAG (SEQ ID NO: XX)

Intein-Cas9(S1006)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVGTALIKKYPKLECLAEGTRIFDPVTGTTHRIEDVVDGRK
PIHVVAAAKDGTLLARPVVSWFDQGTRDVIGLRIAGGAIVWATPDHKVLTEYGWRA
AGELRKGDRVAGPGGSGNSLALSLTADQMVSALLDAEPPILYSEYDPTSPFSEASMM
GLLTNLADRELVHMINWAKRVPGFVDLTLHDQAHLLERAWLEILMIGLVWRSMEH
PGKLLFAPNLLLDRNQGKCVEGMVEIFDMLLATSSRFRMMNLQGEEFVCLKSIILLN
SGVYTFLSSTLKSLEEKDHIHRALDKITDTLIHLMAKAGLTLQQQHQRLAQLLLILSHI
RHMSNKGMEHLYSMKYKNVVPLYDLLLEMLDAHRLHAGGSGASRVQAFADALDDD
KFLHDMLAEGLRYSVIREVLPTRRARTFDLEVEELHTLVAEGVVVHNCEFVYGDYK
VYDVRKMIAKSEQEIGKATAKYFFYSNIMNFFKTEITLANGEIRKRPLIETNGETGEIV
WDKGRDFATVRKVLSMPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKG
YKEVKKDLIIKLPKYSLFELENGRKRMLASAGELQKGNELALPSKYVNFLYLASHYE
KLKGSPEDNEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQSITGLYETRID
LSQLGGDGSPKKKRKVSSDYKDHDGDYKDHDIDYKDDDDKAAG (SEQ ID NO: XX)

Intein-Cas9(S1154)-NLS-3 × FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVGTALIKKYPKLESEFVYGDYKVYDVRKMIAKSEQEIGK
ATAKYFFYSNIMNFFKTEITLANGEIRKRPLIETNGETGEIVWDKGRDFATVRKVLSM
PQVNIVKKTEVQTGGFSKESILPKRNSDKLIARKKDWDPKKYGGFDSPTVAYSVLVV
AKVEKGKCLAEGTRIFDPVTGTTHRIEDVVDGRKPIHVVAAAKDGTLLARPVVSWF
DQGTRDVIGLRIAGGAIVWATPDHKVLTEYGWRAAGELRKGDRVAGPGGSGNSLA
LSLTADQMVSALLDAEPPILYSEYDPTSPFSEASMMGLLTNLADRELVHMINWAKRV
PGFVDLTLHDQAHLLERAWLEILMIGLVWRSMEHPGKLLFAPNLLLDRNQGKCVEG
MVEIFDMLLATSSRFRMMNLQGEEFVCLKSIILLNSGVYTFLSSTLKSLEEKDHIHRA
LDKITDTLIHLMAKAGLTLQQQHQRLAQLLLILSHIRHMSNKGMEHLYSMKYKNVV
PLYDLLLEMLDAHRLHAGGSGASRVQAFADALDDKFLHDMLAEGLRYSVIREVLPT
RRARTFDLEVEELHTLVAEGVVVHNCKKLSVKELLGITIMERSSFEKNPIDFLEAKG
YKEVKKDLIIKLPKYSLFELENGRKRMLASAGELQKGNELALPSKYVNFLYLASHYE |

| Sequences |
|---|
| KLKGSPEDNEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQSITGLYETRID
LSQLGGDGSPKKKRKVSSDYKDHDGDYKDHDIDYKDDDDKAAG (SEQ ID NO: XX)

Intein-Cas9(S1159)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVGTALIKKYPKLESEFVYGDYKVYDVRKMIAKSEQEIGK
ATAKYFFYSNIMNFFKTEITLANGEIRKRPLIETNGETGEIVWDKGRDFATVRKVLSM
PQVNIVKKTEVQTGGFSKESILPKRNSDKLIARKKDWDPKKYGGFDSPTVAYSVLVV
AKVEKGKSKKLK<u>CLAEGTRIFDPVTGTTHRIEDVVDGRKPIHVVAAAKDGTLLARPV</u>
<u>VSWFDQGTRDVIGLRIAGGAIVWATPDHKVLTEYGWRAAGELRKGDRVAGPGGSG</u>
<u>NSLALSLTADQMVSALLDAEPPILYSEYDPTSPFSEASMMGLLTNLADRELVHMINW</u>
<u>AKRVPGFVDLTLHDQAHLLERAWLEILMIGLVWRSMEHPGKLLFAPNLLLDRNQGK</u>
<u>CVEGMVEIFDMLLATSSRFRMMNLQGEEFVCLKSIILLNSGVYTFLSSTLKSLEEKDH</u>
<u>IHRALDKITDTLIHLMAKAGLTLQQQHQRLAQLLLILSHIRHMSNKGMEHLYSMKYK</u>
<u>NVVPLYDLLLEMLDAHRLHAGGSGASRVQAFADALDDKFLHDMLAEGLRYSVIRE</u>
<u>VLPTRRARTFDLEVEELHTLVAEGVVVH</u>NCVKELLGITIMERSSFEKNPIDFLEAKGY
KEVKKDLIIKLPKYSLFELENGRKRMLASAGELQKGNELALPSKYVNFLYLASHYEK
LKGSPEDNEQKQLFVEQHKHYLDEIIEQISEFSKRVILADANLDKVLSAYNKHRDKPI
REQAENIIHLFTLTNLGAPAAFKYFDTTIDRKRYTSTKEVLDATLIHQSITGLYETRIDL
SQLGGDGSPKKKRKVSSDYKDHDGDYKDHDIDYKDDDDKAAG (SEQ ID NO: XX)

Intein-Cas9(S1274)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVKVVDELVK
VMGRHKPENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKV
REINNYHHAHDAYLNAVVGTALIKKYPKLESEFVYGDYKVYDVRKMIAKSEQEIGK
ATAKYFFYSNIMNFFKTEITLANGEIRKRPLIETNGETGEIVWDKGRDFATVRKVLSM
PQVNIVKKTEVQTGGFSKESILPKRNSDKLIARKKDWDPKKYGGFDSPTVAYSVLVV
AKVEKGKSKKLKSVKELLGITIMERSSFEKNPIDFLEAKGYKEVKKDLIIKLPKYSLFE
LENGRKRMLASAGELQKGNELALPSKYVNFLYLASHYEKLKGSPEDNEQKQLFVEQ
HKHYLDEIIEQI<u>CLAEGTRIFDPVTGTTHRIEDVVDGRKPIHVVAAAKDGTLLARPVV</u>
<u>SWFDQGTRDVIGLRIAGGAIVWATPDHKVLTEYGWRAAGELRKGDRVAGPGGSGN</u>
<u>SLALSLTADQMVSALLDAEPPILYSEYDPTSPFSEASMMGLLTNLADRELVHMINWA</u>
<u>KRVPGFVDLTLHDQAHLLERAWLEILMIGLVWRSMEHPGKLLFAPNLLLDRNQGKC</u>
<u>VEGMVEIFDMLLATSSRFRMMNLQGEEFVCLKSIILLNSGVYTFLSSTLKSLEEKDHI</u>
<u>HRALDKITDTLIHLMAKAGLTLQQQHQRLAQLLLILSHIRHMSNKGMEHLYSMKYK</u>
<u>NVVPLYDLLLEMLDAHRLHAGGSGASRVQAFADALDDKFLHDMLAEGLRYSVIRE</u>
<u>VLPTRRARTFDLEVEELHTLVAEGVVVHN</u>CEFSKRVILADANLDKVLSAYNKHRDK
PIREQAENIIHLFTLTNLGAPAAFKYFDTTIDRKRYTSTKEVLDATLIHQSITGLYETRI
DLSQLGGDGSPKKKRKVSSDYKDHDGDYKDHDIDYKDDDDKAAG (SEQ ID NO: XX)

Intein-Cas9(S219-G221R)-NLS-3 x FLAG:
MDKKYSIGLDIGTNSVGWAVITDEYKVPSKKFKVLGNTDRHSIKKNLIGALLFDSGE
TAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSK<u>CLAEGTRIFDPV</u> |

| Sequences |
|---|
| TGTTHRIEDVVDGRKPIHVVAAAKDGTLLARPVVSWFDQGTRDVIGLRIAGGAIVW<br>ATPDHKVLTEYGWRAAGELRKGDRVAGPGGSGNSLALSLTADQMVSALLDAEPPIL<br>YSEYDPTSPFSEASMMGLLTNLADRELVHMINWAKRVPGFVDLTLHDQAHLLERA<br>WLEILMIGLVWRSMEHPGKLLFAPNLLLDRNQGKCVEGMVEIFDMLLATSSRFRMM<br>NLQGEEFVCLKSIILLNSGVYTFLSSTLKSLEEKDHIHRALDKITDTLIHLMAKAGLTL<br>QQQHQRLAQLLLILSHIRHMSNK<u>R</u>MEHLYSMKYKNVVPLYDLLLEMLDAHRLHAG<br>GSGASRVQAFADALDDKFLHDMEAEGLRYSVIREVLPTRRARTFDLEVEELHTLVAE<br>GVVVHNCRRLENLIAQLPGEKKNGLFGNLIALSLGLTPNFKSNFDLAEDAKLQLSKD<br>TYDDDLDNLLAQIGDQYADLFLAAKNLSDAILLSDILRVNTEITKAPLSASMIKRYDE<br>HHQDLTLLKALVRQQLPEKYKEIFFDQSKNGYAGYIDGGASQEEFYKFIKPILEKMD<br>GTEELLVKLNREDLLRKQRTFDNGSIPHQIHLGELHAILRRQEDFYPFLKDNREKIEKI<br>LTFRIPYYVGPLARGNSRFAWMTRKSEETITPWNFEEVVDKGASAQSFIERMTNFDK<br>NLPNEKVLPKHSLLYEYFTVYNELTKVKYVTEGMRKPAFLSGEQKKAIVDLLFKTNR<br>KVTVKQLKEDYFKKIECFDSVEISGVEDRFNASLGTYHDLLKIIKDKDFLDNEENEDI<br>LEDIVLTLTLFEDREMIEERLKTYAHLFDDKVMKQLKRRRYTGWGRLSRKLINGIRD<br>KQSGKTILDFLKSDGFANRNFMQLIHDDSLTFKEDIQKAQVSGQGDSLHEHIANLAG<br>SPAIKKGILQTVKVVDELVKVMGRHKPENIVIEMARENQTTQKGQKNSRERMKRIEE<br>GIKELGSQILKEHPVENTQLQNEKLYLYYLQNGRDMYVDQELDINRLSDYDVDHIVP<br>QSFLKDDSIDNKVLTRSDKNRGKSDNVPSEEVVKKMKNYWRQLLNAKLITQRKFDN<br>LTKAERGGLSELDKAGFIKRQLVETRQITKHVAQILDSRMNTKYDENDKLIREVKVIT<br>LKSKLVSDFRKDFQFYKVREINNYHHAHDAYLNAVVGTALIKKYPKLESEFVYGDY<br>KVYDVRKMIAKSEQEIGKATAKYFFYSNIMNFFKTEITLANGEIRKRPLIETNGETGEI<br>VWDKGRDFATVRKVLSMPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAK<br>GYKEVKKDLIIKLPKYSLFELENGRKRMLASAGELQKGNELALPSKYVNFLYLASHY<br>EKLKGSPEDNEQKQLFVEQHKHYLDEIIEQISEFSKRVILADANLDKVLSAYNKHRDK<br>PIREQAENIIHLFTLTNLGAPAAFKYFDTTIDRKRYTSTKEVLDATLIHQSITGLYETRI<br>DLSQLGGDGSPKKKRKVSSDYKDHDGDYKDHDIDYKDDDDKAAG (SEQ ID NO: XX) |

Indel Calling Algorithm  
Read 1:  
@M00265:68:000000000-AA85W:1:1101:14923:1642 1:N:0:1  
TGCAGTCTCATGACTTGGCCTTTGTAGGAAAACACCATTAGAAGAG<u>TAGATGGTT</u>  
<u>GGGTAGTGGCT</u>CTCTTCTGCTTAGACTCTTGTCTACTATGAATAAAGGGCTCTA  
TTTGCAAAGGCCGTGATGGGTTGAAGCACATTGAGAAAGAGGCT  
+  
3>>A?FFFFFFFGGGGBGGGGHHGHHHGHHHGHHHGHHHHGHHHGHHHHHHHHH  
GGGGHGHFHGGHHHHHHGHHHHHHHHHHHHHGHFHHGHHHHHHHHHFGGHH  
HHHHHHHHHGHHHG@EEHHHHHGGHHHHHHHHHHHHHHHHHHHGG Read 2:  
@M00265:68:000000000-AA85W:1:1101:14923:1642 2:N:0:1  
CTCACCTGGGCGAGAAAGGTAACTTATGTTTCAGTAGCCTCTTTCTCAATGTGCTT  
CAACCCATCACGGCCTTTGCAAATAGAG<u>CCCTTTATTCATAGTAGACAA</u>GAGTCT  
AAGCAGAAGAG<u>AGCCACTACCCAACCATCTA</u>CTCTTCTAATGGT  
+  
3>>AAFCFFBBBGGGGGGGGGGHGHHHHHHHHHHHHHHHHHHHHHHHGH  
HHHHHHHHGGHHFHDFGGGHHHHHHHHGHFHHGGHHHHHHHHHFHHHHHH  
HHHHHGHHHHHGHHHGHGHHHHHHHHHHGGGHHHGHHGHHHHHHHHH@

45

Step 1: Search for sequences (or reverse complements) flanking the on/off target sites in both Illumina reads from the following set:

| target site | 5' flanking sequence | 3' flanking sequence |
|---|---|---|
| EMX_On | GAGTCCGAGCAGAAGAAGAAGGG | AGCTGGAGGAGGAAGGGCCT CTCCCATCACATCAACCGGT |
| EMX_Off1 | GAGGCCGAGCAGAAGAAAGACGG | CCCCTTCTTCTGCAAATGAG CGACAGATGTTGGGGGGAGG |
| EMX_Off2 | GAGTCCTAGCAGGAGAAGAAGAG | GGCTGGGGCCAGCATGACCT GCAGCCTAGAGTCTTCTGTG |
| EMX_Off3 | GAGTCTAAGCAGAAGAAGAAGAG | CCTTTATTCATAGTAGACAA AGCCACTACCCAACCATCTA |
| EMX_Off4 | GAGTTAGAGCAGAAGAAGAAAGG | CATGGCAAGACAGATTGTCA CATGGAGTAAAGGCAATCTT |
| | | |
| VEGF_On | GGGTGGGGGGAGTTTGCTCCTGG | GGGAATGGGCTTTGGAAAGG ACCCCCTATTTCTGACCTCC |
| VEGF_Off1 | GGATGGAGGGAGTTTGCTCCTGG | CATCTAAGGACGGATTTGTG GGTGTCAGAATGTCCTGTCT |
| VEGF_Off2 | GGGAGGGTGGAGTTTGCTCCTGG | CTGGTCAGCCCATTATGATA GGATGGAAGGGCCGGCTCCG |
| VEGF_Off3 | CGGGGGAGGGAGTTTGCTCCTGG | CTGGAGAGAGGCTCCCATCA GGAACCTGTGATCCCCACAG |
| VEGF_Off4 | GGGGAGGGGAAGTTTGCTCCTGG | CATTTTTGCTGTCACAACTC CATTCAGTGGGTAGAGTCCA |
| | | |
| CLTA_On | GCAGATGTAGTGTTTCCACAGGG | CTGAGTAGGATTAAGATATT TGGCTCTTCAGTGCACCAGC |
| CLTA_Off1 | ACATATGTAGTATTTCCACAGGG | GTTGGGAAGAGATGCATACA AATACAATGGACAAATAACC |
| CLTA_Off2 | CCAGATGTAGTATTCCCACAGGG | GCCTCCTTGATTGAGGTGTC GTCTGGCAGGCCCCTCCTGT |
| CLTA_Off3 | CTAGATGAAGTGCTTCCACATGG | CTCATCTAGAGTTCTTTCCA CTTTCATTAGAGTTTAGTCC |

Step 2: Extract the sequence between the target sites in both reads and ensure that it is identical (reverse complementary) in read 1 and read 2 and all positions within read 1 and read 2 have a quality score>='?' (Phred score>=30)
In above reads, CTCTTCTGCTTAGACTC is reverse complement of GAGTCTAAGCAGAAGAG
Step 3: Align extracted sequence to the reference sequence for the relevant on/off target sequence

```
GAGTCTAAGCAGAAGAAGAAGAG reference sequence

GAGTCTAAGC------AGAAGAG sequence read
```

Step 4: For deletions, count only if deletion occurred in close proximity to expected cleavage site (within 8 bp of 3' end of reference sequence)

Methods and Materials

Cas9, Intein-Cas9, and sgRNA Expression Plasmids.

A plasmid encoding the human codon-optimized *Streptococcus pyogenes* Cas9 nuclease with an NLS and 3xFLAG tag (Addgene plasmid 43861)[5] was used as the wild-type Cas9 expression plasmid. Intein 37R3-2 was subcloned at the described positions into the wild-type Cas9 expression plasmid using USER (NEB M5505) cloning. sgRNA expression plasmids used in this study have been described previously[11]. Plasmid constructs generated in this work will be deposited with Addgene.

Modification of Genomic GFP.

HEK293-GFP stable cells (GenTarget), which constitutively express Emerald GFP, served as the reporter cell line. Cells were maintained in "full serum media": Dulbecco's Modified Eagle's Media plus GlutaMax (Life Technologies) with 10% (vol/vol) FBS and penicillin/streptomycin (1×, Amresco). 5×10$^4$ cells were plated on 48-well collagen-coated Biocoat plates (Becton Dickinson). 16-18 h after plating, cells were transfected with Lipofectamine 2000 (Life Technologies) according to the manufacturer's protocol. Briefly, 1.5 µL of Lipofectamine 2000 was used to transfect 650 ng of total plasmid: 500 ng Cas9 expression plasmid, 125 ng sgRNA expression plasmid, and 25 ng near-infrared iRFP670 expressing plasmid (Addgene plasmid 45457)[26]. 12 h after transfection, the media was replaced with full serum media, with or without 4-HT (1 µM, Sigma-Aldrich T176). The media was replaced again 3-4 days after transfection. Five days after transfection, cells were trypsinized and resuspended in full serum media and analyzed on a C6 flow cytometer (Accuri) with a 488-nm laser excitation and 520-nm filter with a 20-nm band pass. Transfections and flow cytometry measurements were performed in triplicate.

High-Throughput DNA Sequencing of Genome Modifications.

HEK293-GFP stable cells were transfected with plasmids expressing Cas9 (500 ng) and sgRNA (125 ng) as described above. For treatments in which a reduced amount of wild-type Cas9 expression plasmid was transfected, pUC19 plasmid was used to bring the total amount of plasmid to 500 ng. 4-HT (1 µM final), where appropriate, was added during transfection. 12 h after transfection, the media was replaced with full serum media without 4-HT. Genomic DNA was isolated and pooled from three biological replicates 60 h after transfection using a previously reported[11] protocol with a DNAdvance Kit (Agencourt). 150 ng or 200 ng of genomic DNA was used as a template to amplify by PCR the on-target and off-target genomic sites with flanking HTS primer pairs described previously[11]. PCR products were purified using RapidTips (Diffinity Genomics) and quantified using the PicoGreen dsDNA Assay Kit (Invitrogen). Purified DNA was PCR amplified with primers containing sequencing adaptors, purified with the MinElute PCR Purification Kit (Qiagen) and AMPure XP PCR Purification (Agencourt). Samples were sequenced on a MiSeq high-throughput DNA sequencer (Illumina), and sequencing data was analyzed as described previously[4].

Western Blot Analysis of Intein Splicing.

HEK293-GFP stable cells were transfected with 500 ng Cas9 expression plasmid and 125 ng sgRNA expression plasmid. 12 h after transfection, the media was replaced with full serum media, with or without 4-HT (1 µM). Cells were lysed and pooled from three technical replicates 4, 8, 12, or 24 h after 4-HT treatment. Samples were run on a Bolt 4-12% Bis-Tris gel (Life Technologies). An anti-FLAG antibody (Sigma-Aldrich F1804) and an anti-mouse 800CW IRDye (LI-COR) were used to visualize the gel on an Odyssey IR imager.

Statistical Analysis.

Statistical tests were performed as described in the figure captions. All p-values were calculated with the R software package. p-values for the Fisher exact test were calculated using the fisher.test function, with a one-sided alternative hypothesis (alternative="greater" or alternative="less", as appropriate). Upper bounds on p-values that are close to zero were determined manually. The Benjamini-Hochberg adjustment was performed using the R function p.adjust (method="fdr").

Sensitivity Limit of Off-Target Cleavage Assays.

We used paired end sequencing to identify indels caused by genomic on- and off-target cleavage. Given that published studies (see the reference below) have shown that the Illumina platform has an indel rate that is several orders of magnitude lower than the ~0.1% substitution error rate, and our requirement that all called indels occur in both paired reads, the sensitivity of the high-throughput sequencing method for detecting genomic off-target cleavage in our study is limited by the amount genomic DNA (gDNA) input into the PCR amplification of each genomic target site. A 1 ng sample of human gDNA represents only ~330 unique genomes, and thus only ~330 unique copies of each genomic site are present. PCR amplification for each genomic target was performed on a total of 150 ng or 200 ng of input gDNA, which provides amplicons derived from at most 50,000 or 65,000 unique gDNA copies, respectively. Therefore, the high-throughput sequencing assay cannot detect rare genome modification events that occur at a frequency of less than approximately 1 in 50,000 (0.002%). When comparing between two conditions, such as wt Cas9 vs. intein-Cas9, this threshold becomes approximately 10 in 50,000 (0.02%) when using the Fisher exact test and a conservative multiple comparison correction (Bonferroni with 14 samples). See also Minoche, A. E., Dohm, J. C., & Himmelbauer, H. Evaluation of genomic high-throughput sequencing data generated on Illumina HiSeq and Genome Analyzer systems. *Genome Biology* 12, R112 (2011).

REFERENCES

1 Jinek, M. et al. A programmable dual-RNA-guided DNA endonuclease in adaptive bacterial immunity. *Science* 337, 816-821 (2012).
2 Mali, P. et al. RNA-guided human genome engineering via Cas9. *Science* 339, 823-826 (2013).
3 Hwang, W. Y. et al. Efficient genome editing in zebrafish using a CRISPR-Cas system. *Nature biotechnology* 31, 227-229 (2013).

4 Pattanayak, V. et al. High-throughput profiling of off-target DNA cleavage reveals RNA-programmed Cas9 nuclease specificity. *Nature biotechnology* 31, 839-843 (2013).

5 Fu, Y. et al. High-frequency off-target mutagenesis induced by CRISP-Cas nucleases in human cells. *Nature biotechnology* 31, 822-826 (2013).

6 Hsu, P. D. et al. DNA targeting specificity of RNA-guided Cas9 nucleases. *Nature biotechnology* 31, 827-832 (2013).

7 Cho, S. W. et al. Analysis of off-target effects of CRISPR/Cas-derived RNA-guided endonucleases and nickases. *Genome research* 24, 132-141 (2014).

8 Tsai, S. Q. et al. GUIDE-seq enables genome-wide profiling of off-target cleavage by CRISPR-Cas nucleases. *Nature biotechnology* 33, 187-197 (2015).

9 Mali, P. et al. CAS9 transcriptional activators for target specificity screening and paired nickases for cooperative genome engineering. *Nature biotechnology* 31, 833-838 (2013).

10 Ran, F. A. et al. Double nicking by RNA-guided CRISPR Cas9 for enhanced genome editing specificity. *Cell* 154, 1380-1389 (2013).

11 Guilinger, J. P., Thompson, D. B. & Liu, D. R. Fusion of catalytically inactive Cas9 to FokI nuclease improves the specificity of genome modification. *Nature biotechnology* 32, 577-582 (2014).

12 Tsai, S. Q. et al. Dimeric CRISPR RNA-guided FokI nucleases for highly specific genome editing. *Nature biotechnology* 32 (2014).

13 Fu, Y., Sander, J. D., Reyon, D., Cascio, V. M. & Joung, J. K. Improving CRISPR-Cas nuclease specificity using truncated guide RNAs. *Nature biotechnology* 32(2014).

14 Kim, S., Kim, D., Cho, S. W., Kim, J. & Kim, J. S. Highly efficient RNA-guided genome editing in human cells via delivery of purified Cas9 ribonucleoproteins. *Genome research* 24, 1012-1019 (2014).

15 Ramakrishna, S. et al. Gene disruption by cell-penetrating peptide-mediated delivery of Cas9 protein and guide RNA. *Genome research* 24, 1020-1027 (2014).

16 Zuris, J. A. et al. Cationic lipid-mediated delivery of proteins enables efficient protein-based genome editing in vitro and in vivo. *Nature biotechnology* 33, 73-80 (2015).

17 Wang, T., Wei, J. J., Sabatini, D. M. & Lander, E. S. Genetic screens in human cells using the CRISPR-Cas9 system. *Science* 343, 80-84 (2014).

18 Gonzalez, F. et al. An iCRISPR platform for rapid, multiplexable, and inducible genome editing in human pluripotent stem cells. *Cell stem cell* 15, 215-226 (2014).

19 Pruett-Miller, S. M., Reading, D. W., Porter, S. N. & Porteus, M. H. Attenuation of zinc finger nuclease toxicity by small-molecule regulation of protein levels. *PLoS genetics* 5, e1000376 (2009).

20 Buskirk, A. R., Ong, Y. C., Gartner, Z. J. & Liu, D. R. Directed evolution of ligand dependence: small-molecule-activated protein splicing. *Proceedings of the National Academy of Sciences of the United States of America* 101, 10505-10510 (2004).

21 Yuen, C. M., Rodda, S. J., Vokes, S. A., McMahon, A. P. & Liu, D. R. Control of transcription factor activity and osteoblast differentiation in mammalian cells using an evolved small-molecule-dependent intein. *Journal of the American Chemical Society* 128, 8939-8946 (2006).

22 Peck, S. H., Chen, I. & Liu, D. R. Directed evolution of a small-molecule-triggered intein with improved splicing properties in mammalian cells. *Chemistry & biology* 18, 619-630 (2011).

23 Jinek, M. et al. Structures of Cas9 endonucleases reveal RNA-mediated conformational activation. *Science* 343, 1247997 (2014).

24 Danielian, P. S., White, R., Hoare, S. A., Fawell, S. E. & Parker, M. G. Identification of residues in the estrogen receptor that confer differential sensitivity to estrogen and hydroxytamoxifen. *Molecular endocrinology* 7, 232-240 (1993).

25 Zetsche, B., Volz, S. E. & Zhang, F. A split-Cas9 architecture for inducible genome editing and transcription modulation. *Nature biotechnology* 33, 139-142 (2015).

26 Shcherbakova, D. M. & Verkhusha, V. V. Near-infrared fluorescent proteins for multicolor in vivo imaging. *Nature methods* 10, 751-754 (2013).

All publications, patents, patent applications, publication, and database entries (e.g., sequence database entries) mentioned herein, e.g., in the Background, Summary, Detailed Description, Examples, and References sections, are incorporated by reference in their entirety as if each individual publication, patent, patent application, publication, and database entry was specifically and individually incorporated herein by reference. In case of conflict, the present application, including any definitions herein, will control.

EQUIVALENTS AND SCOPE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (173 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1368 aa, Streptococcus pyogenes [sequence omitted]

SEQ ID NO: 3 - DNA, 4104 bp, Homo sapiens
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgac

SEQ ID NO: 4 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 6 - protein, 198 aa, Artificial Sequence
  Synthetic Polypeptide
GSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 7 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 8 - protein, 413 aa, Artificial Sequence
  Synthetic Polypeptide
CLAEGTRIFDPVTGTTHRIEDVVDGRKPIHVVAVAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYTNVVPLYDLLLEMLDAHRLHAGGSGASRVQAFADALDDKFLHDMLAEELRYSVIREVLPTRRARTFDLEVEELHTLVAEGVVVHNC

SEQ ID NO: 9 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 10 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 11 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 12 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYNPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 13 - protein, 413 aa, Artificial Sequence
  Synthetic Polypeptide
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 14 - protein, 413 aa, Artificial Sequence
  Synthetic Polypeptide
CLAEGTRIFDPVTGTTHRIEDVVDGRKPIHVVAVAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 15 - protein, 18 aa, Artificial Sequence
  Synthetic Polypeptide
GGSGGSGGSGGSGGSGGS

SEQ ID NO: 16 - protein, 16 aa, Artificial Sequence
  Synthetic Polypeptide
SGSETPGTSESATPES

SEQ ID NO: 17 - protein, 12 aa, Artificial Sequence
  Synthetic Polypeptide
SGSETPGTSESA

SEQ ID NO: 18 - protein, 21 aa, Artificial Sequence
  Synthetic Polypeptide
SGSETPGTSESATPEGGSGGS

SEQ ID NO: 19 - protein, 15 aa, Artificial Sequence
  Synthetic Polypeptide
VPFLLEPDNINGKTC

SEQ ID NO: 20 - protein, 12 aa, Artificial Sequence
  Synthetic Polypeptide
GSAGSAAGSGEF

SEQ ID NO: 21 - protein, 12 aa, Artificial Sequence
  Synthetic Polypeptide
SIVAQLSRPDPA

SEQ ID NO: 22 - protein, 10 aa, Artificial Sequence
  Synthetic Polypeptide
MKIIEQLPSA

SEQ ID NO: 23 - protein, 10 aa, Artificial Sequence
  Synthetic Polypeptide
VRHKLKRVGS

SEQ ID NO: 24 - protein, 12 aa, Artificial Sequence
  Synthetic Polypeptide
GHGTGSTGSGSS

SEQ ID NO: 25 - protein, 7 aa, Artificial Sequence
  Synthetic Polypeptide
MSRPDPA

SEQ ID NO: 26 - protein, 4 aa, Artificial Sequence
  Synthetic Polypeptide
GGSM

SEQ ID NO: 27 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 30 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 31 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 34 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLECLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1780 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQICLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 42 - protein, 16 aa, Artificial Sequence
  Synthetic Polypeptide
MAPKKKRKVGIHRGVP

SEQ ID NO: 43 - protein, 23 aa, Artificial Sequence
  Synthetic Polypeptide
MDYKDHDGDYKDHDIDYKDDDDK

SEQ ID NO: 44 - DNA, 432 bp, Artificial Sequence
  Synthetic Polynucleotide
atggccctgtttggctacgcacgcgtgtctaccagtcaacagtcactcgatttgcaagtgagggctcttaaagatgccggagtgaaggcaaacagaatttttactgataaggccagcggaagcagcacagacagagaggggctggatctcctgagaatgaaggtaaaggagggtgatgtgatcttggtcaaaaaattggatcgactggggagagacacagctgatatgcttcagcttattaaagagtttgacgctcagggtgttgccgtgaggtttatcgatgacggcatctcaaccgactcctacattggtcttatgtttgtgacaattttgtccgctgtggctcaggctgagcggagaaggattctcgaaaggacgaatgagggacggcaagcagctaagttgaaaggtatcaaatttggcagacgaagg

SEQ ID NO: 45 - protein, 144 aa, Artificial Sequence
  Synthetic Polypeptide
MALFGYARVSTSQQSLDLQVRALKDAGVKANRIFTDKASGSSTDREGLDLLRMKVKEGDVILVKKLDRLGRDTADMLQLIKEFDAQGVAVRFIDDGISTDSYIGLMFVTILSAVAQAERRRILERTNEGRQAAKLKGIKFGRRR

SEQ ID NO: 46 - DNA, 414 bp, Artificial Sequence
  Synthetic Polynucleotide
atggcaaccattggctacataagggtgtctaccatcgaccaaaatatcgacctgcagcgcaacgctctgacatccgccaactgcgatcggatcttcgaggataggatcagtggcaagatcgccaaccggcccggtctgaagcgggctctgaagtacgtgaataagggcgatactctggttgtgtggaagttggatcgcttgggtagatcagtgaagaatctcgtagccctgataagcgagctgcacgagaggggtgcacatttccattctctgaccgattccatcgatacgtctagcgccatgggccgattcttcttttacgtcatgtccgccctcgctgaaatggagcgcgaacttattgttgaacggactttggctggactggcagcggctagagcacagggccgacttgga

SEQ ID NO: 47 - protein, 138 aa, Artificial Sequence
  Synthetic Polypeptide
MATIGYIRVSTIDQNIDLQRNALTSANCDRIFEDRISGKIANRPGLKRALKYVNKGDTLVVWKLDRLGRSVKNLVALISELHERGAHFHSLTDSIDTSSAMGRFFFYVMSALAEMERELIVERTLAGLAAARAQGRLG

SEQ ID NO: 48 - DNA, 432 bp, Artificial Sequence
  Synthetic Polynucleotide
atgctcattggctatgtaagggtcagcaccaatgaccaaaacacagacttgcaacgcaatgctttggtttgcgccggatgtgaacagatatttgaagataaactgagcggcactcggacagacagacctgggcttaagagagcactgaaaagactgcagaagggggacaccctggtcgtctggaaactggatcgcctcggacgcagcatgaaacatctgattagcctggttggtgagcttagggagagaggaatcaacttcagaagcctgaccgactccatcgacaccagtagccccatgggacgattcttcttctatgtgatgggagcacttgctgagatggaaagagagcttattatcgaaagaactatggctggtatcgctgctgcccggaacaaaggcagacggttcggcagaccgccgaagagcggc

SEQ ID NO: 49 - protein, 144 aa, Artificial Sequence
  Synthetic Polypeptide
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGIAAARNKGRRFGRPPKSG

SEQ ID NO: 50 - protein, 198 aa, Homo sapiens [sequence omitted]

SEQ ID NO: 51 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 52 - protein, 198 aa, Canis lupus familiaris
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 53 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 54 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 55 - protein, 429 aa, Rattus rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 56 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 57 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 58 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 59 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 60 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 61 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 62 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 63 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 64 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 65 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 66 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 67 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 68 - protein, 229 aa, Rattus rattus [sequence omitted]

SEQ ID NO: 69 - protein, 191 aa, Homo sapiens
MEAKAAPKPAASGACSVSAEETEKWMEEAMHMAKEALENTEVPVGCLMVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 70 - protein, 191 aa, Mus musculus
MEEKVESTTTPDGPCVVSVQETEKWMEEAMRMAKEALENIEVPVGCLMVYNNEVVGKGRNEVNQTKNATRHAEMVAIDQVLDWCHQHGQSPSTVFEHTVLYVTVEPCIMCAAALRLMKIPLVVYGCQNERFGGCGSVLNIASADLPNTGRPFQCIPGYRAEEAVELLKTFYKQENPNAPKSKVRKKDCQKS

SEQ ID NO: 71 - protein, 499 aa, Mus musculus
MWTADEIAQLCYAHYNVRLPKQGKPEPNREWTLLAAVVKIQASANQACDIPEKEVQVTKEVVSMGTGTKCIGQSKMRESGDILNDSHAEIIARRSFQRYLLHQLHLAAVLKEDSIFVPGTQRGLWRLRPDLSFVFFSSHTPCGDASIIPMLEFEEQPCCPVIRSWANNSPVQETENLEDSKDKRNCEDPASPVAKKMRLGTPARSLSNCVAHHGTQESGPVKPDVSSSDLTKEEPDAANGIASGSFRVVDVYRTGAKCVPGETGDLREPGAAYHQVGLLRVKPGRGDRTCSMSCSDKMARWNVLGCQGALLMHFLEKPIYLSAVVIGKCPYSQEAMRRALTGRCEETLVLPRGFGVQELEIQQSGLLFEQSRCAVHRKRGDSPGRLVPCGAAISWSAVPQQPLDVTANGFPQGTTKKEIGSPRARSRISKVELFRSFQKLLSSIADDEQPDSIRVTKKLDTYQEYKDAASAYQEAWGALRRIQPFASWIRNPPDYHQFK

SEQ ID NO: 72 - protein, 502 aa, Homo sapiens
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWAHNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 73 - protein, 57 aa, Artificial Sequence
  Synthetic Polypeptide
GSGRADALDDFDLDMLGSDALDDFDLDMLGSDALDDFDLDMLGSDALDDFDLDMLIN

SEQ ID NO: 74 - protein, 85 aa, Artificial Sequence
  Synthetic Polypeptide
APPTDVSLGDELHLDGEDVAMAHADALDDFDLDMLGDGDSPGPGFTPHDSAPYGALDMADFEFEQMFTDALGIDEYGGEFPGIRR

SEQ ID NO: 75 - protein, 184 aa, Artificial Sequence
  Synthetic Polypeptide
PSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQ

SEQ ID NO: 76 - protein, 94 aa, Homo sapiens
MNMFKEAVTFKDVAVAFTEEELGLLGPAQRKLYRDVMVENFRNLLSVGHPPFKQDVSPIERNEQLWIMTTATRRQGNLDTLPVKALLLYDLAQT

SEQ ID NO: 77 - protein, 74 aa, Homo sapiens
EQVSFKDVCVDFTQEEWYLLDPAQKILYRDVILENYSNLVSVGYCITKPEVIFKIEQGEEPWILEKGFPSQCHP

SEQ ID NO: 78 - protein, 42 aa, Homo sapiens
EAVTFKDVAVVFTEEELGLLDPAQRKLYRDVMLENFRNLLSV

SEQ ID NO: 79 - protein, 69 aa, Mus musculus
MDLVTYDDVHVNFTQDEWALLDPSQKSLYKGVMLETYKNLTAIGYIWEEHTIEDHFQTSRSHGSNKKTH

SEQ ID NO: 80 - protein, 32 aa, Artificial Sequence
  Synthetic Polypeptide
GSGMNIQMLLEAADYLERREREAEHGYASMLP

SEQ ID NO: 81 - protein, 130 aa, Artificial Sequence
  Synthetic Polypeptide
GSGMNIQMLLEAADYLERREREAEHGYASMLPGSGMNIQMLLEAADYLERREREAEHGYASMLPGSGMNIQMLLEAADYLERREREAEHGYASMLPGSGMNIQMLLEAADYLERREREAEHGYASMLPSR

SEQ ID NO: 82 - protein, 876 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGQAGGLQDDSSGGYGDGQASGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQADTVKVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 83 - protein, 852 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 84 - protein, 817 aa, Artificial Sequence
  Synthetic Polypeptide
SIVAQLSRPDPALAALTNDHLVALACLGGRPALDAVKKGLPHAPALIKRTNRRIPERTSHRVADHAQVVRVLGFFQCHSHPAQAFDDAMTQFGMSGGGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 85 - protein, 340 aa, X. laevis
ASSPKKKRKVEASMSRVVKPKVASMEEMAAFHTDAYLQHLHKVSEEGDNDDPETLEYGLGYDCPITEGIYDYAAAVGGATLTAAEQLIEGKTRIAVNWPGGWHHAKKDEASGFCYLNDAVLGILKLREKFDRVLYVDMDLHHGDGVEDAFSFTSKVMTVSLHKFSPGFFPGTGDVSDIGLGKGRYYSINVPLQDGIQDDKYYQICEGVLKEVFTTFNPEAVVLQLGADTIAGDPMCSFNMTPEGIGKCLKYVLQWQLPTLILGGGGYHLPNTARCWTYLTALIVGRTLSSEIPDHEFFTEYGPDYVLEITPSCRPDRNDTQKVQEILQSIKGNLKRVVEF

SEQ ID NO: 86 - protein, 337 aa, S. cerevisiae
ASSPKKKRKVEASRRVAYFYDADVGNYAYGAGHPMKPHRIRMAHSLIMNYGLYKKMEIYRAKPATKQEMCQFHTDEYIDFLSRVTPDNLEMFKRESVKFNVGDDCPVFDGLYEYCSISGGGSMEGAARLNRGKCDVAVNYAGGLHHAKKSEASGFCYLNDIVLGIIELLRYHPRVLYIDIDVHHGDGVEEAFYTTDRVMTCSFHKYGEFFPGTGELRDIGVGAGKNYAVNVPLRDGIDDATYRSVFEPVIKKIMEWYQPSAVVLQCGGDSLSGDRLGCFNLSMEGHANCVNYVKSFGIPMMVVGGGGYTMRNVARTWCFETGLLNNVVLDKDLPYEF

SEQ ID NO: 87 - protein, 315 aa, M. loti
ASSPKKKRKVEASMPLQIVHHPDYDAGFATNHRFPMSKYPLLMEALRARGLASPDALNTTEPAPASWLKLAHAADYVDQVISCSVPEKIEREIGFPVGPRVSLRAQLATGGTILAARLALRHGIACNTAGGSHHARRAQGAGFCTFNDVAVASLVLLDEGAAQNILVVDLDVHQGDGTADILSDEPGVFTFSMHGERNYPVRKIASDLDIALPDGTGDAAYLRRLATILPELSARARWDIVFYNAGVDVHAEDRLGRLALSNGGLRARDEMVIGHFRALGIPVCGVIGGGYSTDVPALASRHAILFEVASTYAEF

SEQ ID NO: 88 - protein, 362 aa, Homo sapiens
ASSPKKKRKVEASMLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVPEF

SEQ ID NO: 89 - protein, 226 aa, A. thaliana
ASSPKKKRKVEASMEFWGIEVKSGKPVTVTPEEGILIHVSQASLGECKNKKGEFVPLHVKVGNQNLVLGTLSTENIPQLFCDLVFDKEFELSHTWGKGSVYFVGYKTPNIEPQGYSEEEEEEEEEVPAGNAAKAVAKPKAKPAEVKPAVDDEEDESDSDGMDEDDSDGEDSEEEEPTPKKPASSKKRANETTPKAPVSAKKAKVAVTPQKTDEKKKGGKAANQSEF

SEQ ID NO: 90 - protein, 272 aa, Homo sapiens
ASSPKKKRKVEASMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDKEF

SEQ ID NO: 91 - protein, 306 aa, S. cerevisiae
ASSPKKKRKVEASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTAQGGMGEF

SEQ ID NO: 92 - protein, 257 aa, E. coli
ASSPKKKRKVEASMEKPRVLVLTGAGISAESGIRTFRAADGLWEEHRVEDVATPEGFDRDPELVQAFYNARRRQLQQPEIQPNAAHLALAKLQDALGDRFLLVTQNIDNLHERAGNTNVIHMHGELLKVRCSQSGQVLDWTGDVTPEDKCHCCQFPAPLRPHVVWFGEMPLGMDEIYMALSMADIFIAIGTSGHVYPAAGFVHEAKLHGAHTVELNLEPSQVGNEFAEKYYGPASQVVPEFVEKLLKGLKAGSIAEF

SEQ ID NO: 93 - protein, 346 aa, C. albicans
ASSPKKKRKVEASMPSLDDILKPVAEAVKNGKKVTFFNGAGISTGAGIPDFRSPDTGLYANLAKLNLPFAEAVFDIDFFKEDPKPFYTLAEELYPGNFAPTKFHHFIKLLQDQGSLKRVYTQNIDTLERLAGVEDKYIVEAHGSFASNHCVDCHKEMTTETLKTYMKDKKIPSCQHCEGYVKPDIVFFGEGLPVKFFDLWEDDCEDVEVAIVAGTSLTVFPFASLPGEVNKKCLRVLVNKEKVGTFKHEPRKSDIIALHDCDIVAERLCTLLGLDDKLNEVYEKEKIKYSKAETKEIKMHEIEDKLKEEAHLKEDKHTTKVDKKEKQNDANDKELEQLIDKAKAEF

SEQ ID NO: 94 - protein, 289 aa, Homo sapiens
ASSPKKKRKVEASSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVSEF

SEQ ID NO: 95 - protein, 288 aa, P. falciparum
ASSPKKKRKVEASMGNLMISFLKKDTQSITLEELAKIIKKCKHVVALTGSGTSAESNIPSFRGSSNSIWSKYDPRIYGTIWGFWKYPEKIWEVIRDISSDYEIEINNGHVALSTLESLGYLKSVVTQNVDGLHEASGNTKVISLHGNVFEAVCCTCNKIVKLNKIMLQKTSHFMHQLPPECPCGGIFKPNIILFGEVVSSDLLKEAEEEIAKCDLLLVIGTSSTVSTATNLCHFACKKKKKIVEINISKTYITNKMSDYHVCAKFSELTKVANILKGSSEKNKKIMEF

SEQ ID NO: 96 - protein, 304 aa, Homo sapiens
ASSPKKKRKVEASMSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLEF

SEQ ID NO: 97 - protein, 234 aa, C. trachomatis
ASSPKKKRKVEASMTTNSTQDTLYLSLHGGIDSAIPYPVRRVEQLLQFSFLPELQFQNAAVKQRIQRLCYREEKRLAVSSLAKWLGQLHKQRLRAPKNPPVAICWINSYVGYGVFARESIPAWSYIGEYTGILRRRQALWLDENDYCFRYPVPRYSFRYFTIDSGMQGNVTRFINHSDNPNLEAIGAFENGIFHIIIRAIKDILPGEELCYHYGPLYWKHRKKREEFVPQEEEF

SEQ ID NO: 98 - protein, 134 aa, P. bursaria
ASSPKKKRKVEASMFNDRVIVKKSPLGGYGVFARKSFEKGELVEECLCIVRHNDDWGTALEDYLFSRKNMSAMALGFGAIFNHSKDPNARHELTAGLKRMRIFTIKPIAIGEEITISYGDDYWLSRPRLTQNEF

SEQ ID NO: 99 - protein, 349 aa, Homo sapiens
ASSPKKKRKVEASNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLFEF

SEQ ID NO: 100 - protein, 346 aa, N. crassa
ASSPKKKRKVEASMEKAFRPHFFNHGKPDANPKEKKNCHWCQIRSFATHAQLPISIVNREDDAFLNPNFRFIDHSIIGKNVPVADQSFRVGCSCASDEECMYSTCQCLDEMAPDSDEEADPYTRKKRFAYYSQGAKKGLLRDRVLQSQEPIYECHQGCACSKDCPNRVVERGRTVPLQIFRTKDRGWGVKCPVNIKRGQFVDRYLGEIITSEEADRRRAESTIARRKDVYLFALDKFSDPDSLDPLLAGQPLEVDGEYMSGPTRFINHSCDPNMAIFARVGDHADKHIHDLALFAIKDIPKGTELTFDYVNGLTGLESDAHDPSKISEMTKCLCGTAKCRGYLWEF

SEQ ID NO: 101 - protein, 282 aa, A. thaliana
ASSPKKKRKVEASDISGGLEFKGIPATNRVDDSPVSPTSGFTYIKSLIIEPNVIIPKSSTGCNCRGSCTDSKKCACAKLNGGNFPYVDLNDGRLIESRDVVFECGPHCGCGPKCVNRTSQKRLRFNLEVFRSAKKGWAVRSWEYIPAGSPVCEYIGVVRRTADVDTISDNEYIFEIDCQQTMQGLGGRQRRLRDVAVPMNNGVSQSSEDENAPEFCIDAGSTGNFARFINHSCEPNLFVQCVLSSHQDIRLARVVLFAADNISPMQELTYDYGYALDSVHEF

SEQ ID NO: 102 - protein, 328 aa, A. thaliana
ASSPKKKRKVEASQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRCQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWDYMIDFNDKSHPVKAFRCCCGSESCRDRKIKGSQGKSIERRKIVSAKKQQGSKEVSKKRKEF

SEQ ID NO: 103 - protein, 303 aa, C. elegans
ASSPKKKRKVEASMQLHEQIANISVTFNDIPRSDHSMTPTELCYFDDFATTLVVDSVLNFTTHKMSKKRRYLYQDEYRTARTVMKTFREQRDWTNAIYGLLTLRSVSHFLSKLPPNKLFEFRDHIVRFLNMFILDSGYTIQECKRYSQEGHQGAKLVSTGVWSRGDKIERLSGVVCLLSSEDEDSILAQEGSDFSVMYSTRKRCSTLWLGPGAYINHDCRPTCEFVSHGSTAHIRVLRDMVPGDEITCFYGSEFFGPNNIDCECCTCEKNMNGAFSYLRGNENAEPIISEKKTKYELRSRSEF

SEQ ID NO: 104 - protein, 257 aa, C. elegans
ASSPKKKRKVEASMKVAAKKLATSRMRKDRAAAASPSSDIENSENPSSLASHSSSSGRMTPSKNTRSRKGVSVKDVSNHKITEFFQVRRSNRKTSKQISDEAKHALRDTVLKGTNERLLEVYKDVVKGRGIRTKVNFEKGDFVVEYRGVMMEYSEAKVIEEQYSNDEEIGSYMYFFEHNNKKWCIDATKESPWKGRLINHSVLRPNLKTKVVEIDGSHHLILVARRQIAQGEELLYDYGDRSAETIAKNPWLVNTEF

SEQ ID NO: 105 - protein, 224 aa, Homo sapiens
ASSPKKKRKVEASSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAFPWLKHEF

SEQ ID NO: 106 - protein, 319 aa, T. gondii
ASSPKKKRKVEASASRRTGEFLRDAQAPSRWLKRSKTGQDDGAFCLETWLAGAGDDAAGGERGRDREGAADKAKQREERRQKELEERFEEMKVEFEEKAQRMIARRAALTGEIYSDGKGSKKPRVPSLPENDDDALIEIIIDPEQGILKWPLSVMSIRQRTVIYQECLRRDLTACIHLTKVPGKGRAVFAADTILKDDFVVEYKGELCSEREAREREQRYNRSKVPMGSFMFYFKNGSRMMAIDATDEKQDFGPARLINHSRRNPNMTPRAITLGDFNSEPRLIFVARRNIEKGEELLVDYGERDPDVIKEHPWLNSEF

SEQ ID NO: 107 - DNA, 23 bp, Artificial Sequence
  Synthetic Polynucleotide
gagtccgagcagaagaagaaggg

SEQ ID NO: 108 - DNA, 23 bp, Artificial Sequence
  Synthetic Polynucleotide
gaggccgagcagaagaaagacgg

SEQ ID NO: 109 - DNA, 23 bp, Artificial Sequence
  Synthetic Polynucleotide
gagtcctagcaggagaagaagag

SEQ ID NO: 110 - DNA, 23 bp, Artificial Sequence
  Synthetic Polynucleotide
gagtctaagcagaagaagaagag

SEQ ID NO: 111 - DNA, 23 bp, Artificial Sequence
  Synthetic Polynucleotide
gagttagagcagaagaagaaagg

SEQ ID NO: 112 - DNA, 23 bp, Artificial Sequence
  Synthetic Polynucleotide
gggtggggggagtttgctcctgg

SEQ ID NO: 113 - DNA, 23 bp, Artificial Sequence
  Synthetic Polynucleotide
ggatggagggagtttgctcctgg

SEQ ID NO: 114 - DNA, 23 bp, Artificial Sequence
  Synthetic Polynucleotide
gggagggtggagtttgctcctgg

SEQ ID NO: 115 - DNA, 23 bp, Artificial Sequence
  Synthetic Polynucleotide
cgggggagggagtttgctcctgg

SEQ ID NO: 116 - DNA, 23 bp, Artificial Sequence
  Synthetic Polynucleotide
ggggaggggaagtttgctcctgg

SEQ ID NO: 117 - DNA, 23 bp, Artificial Sequence
  Synthetic Polynucleotide
gcagatgtagtgtttccacaggg

SEQ ID NO: 118 - DNA, 23 bp, Artificial Sequence
  Synthetic Polynucleotide
acatatgtagtatttccacaggg

SEQ ID NO: 119 - DNA, 23 bp, Artificial Sequence
  Synthetic Polynucleotide
ccagatgtagtattcccacaggg

SEQ ID NO: 120 - DNA, 23 bp, Artificial Sequence
  Synthetic Polynucleotide
ctagatgaagtgcttccacatgg

SEQ ID NO: 121 - DNA, 20 bp, Artificial Sequence
  Synthetic Polynucleotide
agctggaggaggaagggcct

SEQ ID NO: 122 - DNA, 20 bp, Artificial Sequence
  Synthetic Polynucleotide
ccccttcttctgcaaatgag

SEQ ID NO: 123 - DNA, 20 bp, Artificial Sequence
  Synthetic Polynucleotide
ggctggggccagcatgacct

SEQ ID NO: 124 - DNA, 20 bp, Artificial Sequence
  Synthetic Polynucleotide
cctttattcatagtagacaa

SEQ ID NO: 125 - DNA, 20 bp, Artificial Sequence
  Synthetic Polynucleotide
catggcaagacagattgtca

SEQ ID NO: 126 - DNA, 20 bp, Artificial Sequence
  Synthetic Polynucleotide
gggaatgggctttggaaagg

SEQ ID NO: 127 - DNA, 20 bp, Artificial Sequence
  Synthetic Polynucleotide
catctaaggacggatttgtg

SEQ ID NO: 128 - DNA, 20 bp, Artificial Sequence
  Synthetic Polynucleotide
ctggtcagcccattatgata

SEQ ID NO: 129 - DNA, 20 bp, Artificial Sequence
  Synthetic Polynucleotide
ctggagagaggctcccatca

SEQ ID NO: 130 - DNA, 20 bp, Artificial Sequence
  Synthetic Polynucleotide
catttttgctgtcacaactc

SEQ ID NO: 131 - DNA, 20 bp, Artificial Sequence
  Synthetic Polynucleotide
ctgagtaggattaagatatt

SEQ ID NO: 132 - DNA, 20 bp, Artificial Sequence
  Synthetic Polynucleotide
gttgggaagagatgcataca

SEQ ID NO: 133 - DNA, 20 bp, Artificial Sequence
  Synthetic Polynucleotide
gcctccttgattgaggtgtc

SEQ ID NO: 134 - DNA, 20 bp, Artificial Sequence
  Synthetic Polynucleotide
ctcatctagagttctttcca

SEQ ID NO: 135 - DNA, 20 bp, Artificial Sequence
  Synthetic Polynucleotide
ctcccatcacatcaaccggt

SEQ ID NO: 136 - DNA, 20 bp, Artificial Sequence
  Synthetic Polynucleotide
cgacagatgttggggggagg

SEQ ID NO: 137 - DNA, 20 bp, Artificial Sequence
  Synthetic Polynucleotide
gcagcctagagtcttctgtg

SEQ ID NO: 138 - DNA, 20 bp, Artificial Sequence
  Synthetic Polynucleotide
agccactacccaaccatcta

SEQ ID NO: 139 - DNA, 20 bp, Artificial Sequence
  Synthetic Polynucleotide
catggagtaaaggcaatctt

SEQ ID NO: 140 - DNA, 20 bp, Artificial Sequence
  Synthetic Polynucleotide
accccctatttctgacctcc

SEQ ID NO: 141 - DNA, 20 bp, Artificial Sequence
  Synthetic Polynucleotide
ggtgtcagaatgtcctgtct

SEQ ID NO: 142 - DNA, 20 bp, Artificial Sequence
  Synthetic Polynucleotide
ggatggaagggccggctccg

SEQ ID NO: 143 - DNA, 20 bp, Artificial Sequence
  Synthetic Polynucleotide
ggaacctgtgatccccacag

SEQ ID NO: 144 - DNA, 20 bp, Artificial Sequence
  Synthetic Polynucleotide
cattcagtgggtagagtcca

SEQ ID NO: 145 - DNA, 20 bp, Artificial Sequence
  Synthetic Polynucleotide
tggctcttcagtgcaccagc

SEQ ID NO: 146 - DNA, 20 bp, Artificial Sequence
  Synthetic Polynucleotide
aatacaatggacaaataacc

SEQ ID NO: 147 - DNA, 20 bp, Artificial Sequence
  Synthetic Polynucleotide
gtctggcaggcccctcctgt

SEQ ID NO: 148 - DNA, 20 bp, Artificial Sequence
  Synthetic Polynucleotide
ctttcattagagtttagtcc

SEQ ID NO: 149 - DNA, 1239 bp, Artificial Sequence
  Synthetic Polynucleotide
tgccttgccgagggtacccgaatcttcgatccggtcactggtacaacgcatcgcatcgaggatgttgtcgatgggcgcaagcctattcatgtcgtggctgctgccaaggacggaacgctgctcgcgcggcccgtggtgtcctggttcgaccagggaacgcgggatgtgatcgggttgcggatcgccggtggcgccatcgtgtgggcgacacccgatcacaaggtgctgacagagtacggctggcgtgccgccggggaactccgcaagggagacagggtggccggaccgggtggttctggtaacagcctggccttgtccctgacggccgaccagatggtcagtgccttgttggatgctgagccccccatactctattccgagtatgatcctaccagtcccttcagtgaagcttcgatgatgggcttactgaccaacctggcagacagggagctggttcacatgatcaactgggcgaagagggtgccaggctttgtggatttgaccctccatgatcaggcccaccttctagaacgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagccctggacaagatcacggacactttgatccacctgatggccaaggcaggcctgaccctgcagcagcagcaccagcggctggcccagctcctcctcatcctctcccacatcaggcacatgagtaacaaaggaatggagcatctgtacagcatgaagtacaagaacgtggtgcccctctatgacctgctgctggagatgctggacgcccaccgcctacatgcgggtggttctggtgctagccgcgtgcaggcgttcgcggatgccctggatgacaaattcctgcacgacatgctggcggaaggactccgctattccgtgatccgagaagtgctgccaacgcggcgggcacgaacgttcgacctcgaggtcgaggaactgcacaccctcgtcgccgaaggggttgtcgtgcacaactgc

SEQ ID NO: 150 - protein, 1404 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 151 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 152 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 153 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 154 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 155 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 156 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 157 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 158 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 159 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 160 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 161 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 162 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLECLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 163 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 164 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 165 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQICLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNCEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 166 - protein, 1816 aa, Artificial Sequence
  Synthetic Polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKCLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKRMEHLYSMKYKNVVPLYDLLLEMLDAHRLHAGGSGASRVQAFADALDDKFLHDMLAEGLRYSVIREVLPTRRARTFDLEVEELHTLVAEGVVVHNCRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 167 - DNA, 153 bp, Artificial Sequence
  Synthetic Polynucleotide
tgcagtctcatgacttggcctttgtaggaaaacaccattagaagagtagatggttgggtagtggctctcttctgcttagactcttgtctactatgaataaagggctctatttgcaaaggccgtgatgggttgaagcacattgagaaagaggct

SEQ ID NO: 168 - DNA, 155 bp, Artificial Sequence
  Synthetic Polynucleotide
ctcacctgggcgagaaaggtaacttatgtttcagtagcctctttctcaatgtgcttcaacccatcacggcctttgcaaatagagccctttattcatagtagacaagagtctaagcagaagagagccactacccaaccatctactcttctaatggt

SEQ ID NO: 169 - DNA, 17 bp, Artificial Sequence
  Synthetic Polynucleotide
ctcttctgcttagactc

SEQ ID NO: 170 - DNA, 17 bp, Artificial Sequence
  Synthetic Polynucleotide
gagtctaagcagaagag

SEQ ID NO: 171 - DNA, 17 bp, Artificial Sequence
  Synthetic Polynucleotide
gagtctaagcagaagag

SEQ ID NO: 172 - protein, 248 aa, Homo sapiens
NSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYTNVVPLYDLLLEMLDAHRLHA

SEQ ID NO: 173 - protein, 248 aa, Artificial Sequence
  Synthetic Polypeptide
  misc_feature (24)..(24): Xaa can be any amino acid
  misc_feature (29)..(29): Xaa can be any amino acid
  misc_feature (78)..(78): Xaa can be any amino acid
  misc_feature (228)..(228): Xaa can be any amino acid
NSLALSLTADQMVSALLDAEPPIXYSEYXPTSPFSEASMMGLLTNLADRELVHMINWAKRVPGFVDLTLHDQAHLLEXAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYXNVVPLYDLLLEMLDAHRLHA

What is claimed is:

1. A Cas9 protein comprising an intein.
2. The Cas9 protein of claim 1, wherein an activity of the Cas9 protein is disrupted by the intein, and wherein the disrupted activity is restored upon excision of the intein from the Cas9 protein.
3. The Cas9 protein of claim 1, wherein the Cas9 protein is capable of binding a guide RNA (gRNA) prior to excision of the intein.
4. The Cas9 protein of claim 1, wherein the Cas9 protein has no or minimal gRNA binding activity prior to excision of the intein.
5. The Cas9 protein of claim 4, wherein the Cas9 protein is a Cas9 protein comprising three domains: (i) a dCas9 domain; (ii) a ligand-dependent intein; and (iii) a nucleic acid-editing domain.
6. The Cas9 protein of claim 5, wherein the nucleic acid-editing domain is a deaminase domain.
7. The Cas9 protein of claim 4, wherein the Cas9 protein comprises: (i) a dCas9 domain; (ii) a ligand-dependent intein; and (iii) a transcriptional activator domain, or a transcriptional repressor domain.
8. The Cas9 protein of claim 4, wherein the Cas9 protein comprises: (i) a dCas9 domain; (ii) a ligand-dependent intein; and (iii) an epigenetic modifier domain.
9. The Cas9 protein of claim 8, wherein the epigenetic modifier is selected from the group consisting of histone demethylase, histone methyltransferase, hydroxylase, histone deacetylase, and histone acetyltransferase.
10. The Cas9 fusion protein of claim 9, wherein the epigenetic modifier comprises the LSD1 histone demethylase or TET1 hydroxylase.
11. The Cas9 protein of claim 1, wherein the Cas9 protein comprises a nuclease-inactivated Cas9 (dCas9) domain.
12. The Cas9 protein of claim 11, wherein the Cas9 protein comprises: (i) a dCas9 domain; (ii) a ligand-dependent intein; and (iii) a recombinase catalytic domain.
13. The Cas9 protein of claim 1, wherein the Cas9 protein is a Cas9 nickase.
14. The Cas9 protein of claim 1, wherein the intein is a ligand-dependent intein.
15. The Cas9 protein of claim 1, wherein the intein comprises a ligand-binding domain.
16. The Cas9 protein of claim 1, wherein one or more domains of the Cas9 protein are separated by a peptide linker or a non-peptide linker.
17. A method for site-specific DNA cleavage comprising:
   (a) contacting a Cas9 protein of claim 1 with a ligand, wherein binding of the ligand to the intein induces self-excision of the intein; and
   (b) contacting a DNA with the Cas9 protein, wherein the Cas9 protein is associated with a gRNA;
   wherein self-excision of the intein from the Cas9 protein in step (a) allows the RNA-guided nuclease to cleave the DNA, thereby producing cleaved DNA.
18. A method of DNA editing, the method comprising contacting a DNA molecule with (a) a Cas9 protein of claim 5; and
(b) a gRNA targeting the Cas9 protein of (a) to a target nucleotide sequence of the DNA strand;
wherein the DNA molecule is contacted with the Cas9 protein and the gRNA in an amount effective and under conditions suitable for the deamination of a nucleotide base.

19. A method for transcriptional activation, comprising contacting a DNA molecule comprising a gene with
(a) a Cas9 protein of claim 7; and
(b) a gRNA targeting the Cas9 protein of (a) to a target nucleotide sequence of the DNA strand;
wherein the DNA molecule is contacted with the Cas9 protein and the gRNA in an amount effective and under conditions suitable for the transcriptional activation of the gene.

20. A method for epigenetic modification, comprising contacting a DNA molecule with
(a) a Cas9 protein of claim 8; and
(b) a gRNA targeting the Cas9 protein of (a) to a target nucleotide sequence of the DNA strand;
wherein the DNA molecule is contacted with the Cas9 protein and the gRNA in an amount effective and under conditions suitable for the epigenetic modification of the DNA.

21. A method for site-specific recombination between two DNA molecules, comprising:
(a) contacting a first DNA with a first Cas9 protein of claim 12, wherein the dCas9 domain of the first Cas9 protein binds a first gRNA that hybridizes to a region of the first DNA;
(b) contacting the first DNA with a second Cas9 protein of claim 12, wherein the dCas9 domain of the second Cas9 protein binds a second gRNA that hybridizes to a second region of the first DNA;
(c) contacting a second DNA with a third Cas9 protein of claim 12, wherein the dCas9 domain of the third Cas9 protein binds a third gRNA that hybridizes to a region of the second DNA; and
(d) contacting the second DNA with a fourth Cas9 protein of claim 12, wherein the dCas9 domain of the fourth Cas9 protein binds a fourth gRNA that hybridizes to a second region of the second DNA;
wherein the binding of the Cas9 proteins in steps (a)-(d) results in the tetramerization of the recombinase catalytic domains of the Cas9 proteins, under conditions such that the DNAs are recombined.

* * * * *